United States Patent 7,745,391 (HUMAN THROMBOSPONDIN POLYPEPTIDE) - sequence listing, part 78

SEQ ID NO: 279285 - DNA, 2257 bp, Homo sapiens
gcgacttccggcagctggacttggaaaagcaaggagtgtcgggaatggcgaccaagcggctcgcgcggtactcgagggagttccgggtcgggggcgggtagctccgggtccagcgctggcgttggccgcagagcagggcacggcaggtggcatctgcggtgagggcctctattccccgcagccccggcgtctgcgacctgccctctctggcacggttggaaaggcgcctccctggacctcggtcttcagccttgggccaccttctacccgagggtgacaggagcccgaggcggacgaaccctggggccttgactgtgtggccttgagccagtgcctgcctattttaggccttgggaaacgactggacgtgacagtgccctgcagactggttggaggtctcaggcaggccacacactgaatctgtcaaggtgttcaacctgttcgaaatgctcgttcctcggtgctgtaaagaaatagaacttaaacttaaatttaatttatttagtaaggccatttttacttcctgcagaaagggtacactcgccagcagttttgccaggagagtacactgaacaaaggagacagggtcatttataacgtggcgcgtccaccctactgctgtgtccggtttcctttggctggaacgggacctcacattctgtatttgtcccgactgactagcaacatagaactttttaaaagaggcaaaggcagaggagaacaaaggaagaaggaagtaacttgtggaatgctgagaaaggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcagactgggacttgggggtttgcctggagtatgagtgtaaaagaaaacagctgttaaaacctgtgtttttaaattcttggattgatctcagagcaacttacaagcttttctataggagaaaaccaaaaggactaagtggtgccttgcaggaagtaggaatagaattctcaggacgagaacattctgggttggacgattctcggaatactgcccttcttgcttggaaaatgatcagagatggttgtgtaatgaaaattacaaggtcgttgaacaagggtcccttcctcttgccttcgtggacctggaacagtgatctggcctcaggggaccagcatgcttttcttcagcaagaatttgggtatttcttcaatttcttgtcttttggattactattcaggacaaccaatctctcaagaaagggtcaagtacctatcctagctgtggaacctacagaaccttacttcagaagcccaatatgagtaaacaggaaaaggggaatattctctggttgacaatggtgtggctgtcactggcatgtctgcaaaggaaaaactacaatgactgcatgttaaacacagcatcacagactgttaccactgaaaaattttgagaagctctccacttgaacctcttcatgtcatgaatcaggtgccagtggcttagcttgaattacagggtaaaagccatcactttctctatccttttaggtgctttctagaatcaaaactaaactttgtcatcaaaggcccatttataatagctgctttcctagctttttattctatgataaagaaggattgaagcatttttaaaacttgagatttttatcatacctccagcagagtaaggagtctgtgtgatcttgcaatcatggataaggaagaattttccccttccctcccctatggatgctttaaaatgtgattttttaaaaatgagtatgttaatacaatacatgttagtaaaagccatgggtactgatgggccaacacactacagcctactggcaaaatctgacttgcctcttgtttctgtaaataaaatgttattgcccattcattga

SEQ ID NO: 279286 - DNA, 725 bp, Homo sapiens
aaatccctgaagtatgaggtttggagagcaccacgtgccggaaaggtagtgcacccccactccacagggatagaagctgctgcacttgggaccttgtggacctcaccctatgtacctcttcatctggctagctattcatctgtaacttttatcatatcttttataataagctgggaaatgtgtggctgtcactggcatgtctgcaaaggaaaaactacaatgactgcatgttaaacacagcatcacagactgttaccactgaaaaattttgagaagctctccacttgaacctcttcatgtcatgaatcaggtgccagtggcttagcttgaattacagggtaaaagccatcactttctctatccttttaggtgctttctagaatcaaaactaaactttgtcatcaaaggcccatttataatagctgctttcctagctttttattctatgataaagaaggattgaagcatttttaaaacttgagatttttatcatacctccagcagagtaaggagtctgtgtgatcttgcaatcatggataaggaagaattttccccttccctcccctatggatgctttaaaatgtgattttttaaaaatgagtatgttaatacaatacatgttagtaaaagccatgggtactgatgggccaacacactacagcctactggcaaaatctgacttgcctcttgtttctgtaaataaaatgttattgcccattcattga

SEQ ID NO: 279287 - DNA, 927 bp, Homo sapiens
gcgacttccggcagctggacttggaaaagcaaggagtgtcgggaatggcgaccaagcggctcgcgcggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcagactgggacttgggggtttgcctggagtatgagtgtaaaagaaaacagctgttaaaacctgtgtttttaaattcttggattgatctcagagcaacttacaagcttttctataggagaaaaccaaaaggactaagtggtgccttgcaggaagtaggaatagaattctcaggacgagaacattctgggttggacgattctcggaatactgcccttcttgcttggaaaatgatcagagatggttgtgtaatgaaaattacaaggtcgttgaacaaggttcccactaagaagaatttcagcattctggccagaaatttgaatacaattcaagttgaagaaatgtctgcctgtaacattagcatccagggtcccagcatatataataaggagcctaaaaatataataaatcctcatgaaaaagttcaaa

SEQ ID NO: 279288 - DNA, 1542 bp, Homo sapiens
gcgacttccggcagctggacttggaaaagcaaggagtgtcgggaatggcgaccaagcggctcgcgcggtactcgagggagttccgggtcgggggcgggtagctccgggtccagcgctggcgttggccgcagagcagggcacggcaggtggcatctgcggtgagggcctctattccccgcagccccggcgtctgcgacctgccctctctggcacggttggaaaggcgcctccctggacctcggtcttcagccttgggccaccttctacccgagggtgacaggagcccgaggcggacgaaccctggggccttgactgtgtggccttgagccagtgcctgcctattttaggccttgggaaacgactggacgtgacagtgccctgcagactggttggaggtctcaggcaggccacacactgaatctgtcaaggtgttcaacctgttcgaaatgctcgttcctcggtgctgtaaagaaatagaacttaaacttaaatttaatttatttagtaaggccatttttacttcctgcagaaagggtacactcgccagcagttttgccaggagagtacactgaacaaaggagacagggtcatttataacgtggcgcgtccaccctactgctgtgtccggtttcctttggctggaacgggacctcacattctgtatttgtcccgactgactagcaacatagaactttttaaaagaggcaaaggcagaggagaacaaaggaagaaggaagtaacttgtggaatgctgagaaaggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcaggtaaagaataagttatacctattaatcacagatgggtagcattaccactatgtaattctttatttctagttttatacttgctaacctagaattatgtttgttaatcttctgggctaggaaaaaaaatttaaatgcctagcagatgttagccaagaaaagtaaattaatacatattttttaaattaaccttttgggataccttaaaatattaagcctgaacttaaaaaaatgtttctagagttccactgttaagaattaagcaaagatgatttagtgaacactcttatgctattttctacagtcttcatcagctcaacatcctttgcttttatgctttgacactta

SEQ ID NO: 279289 - DNA, 396 bp, Homo sapiens
gttagtagtgtcttgcctttttattctgtcatctcaaacttcataaacagtcatacgttctttgaaacgtagatttaatgtgtgcagtcatttataaatcaatgacatttctcttttttgtcataaaactgtatactgaagaaattaacgaatgcacagtttctaaagctgttgcatttgtctgtggaatcataggttcccactaagaagaatttcagcattctggccagaaatttgaatacaattcaagttgaagaaatgtctgcctgtaacattagcatccagggtcccagcatatataataaggagcctaaaaatataataaatcctcatgaaaaagttcaaatgaagtcaatttgtgcaaattctcctataaaggcacaacaggatcaatta

SEQ ID NO: 279290 - DNA, 1564 bp, Homo sapiens
gcgacttccggcagctggacttggaaaagcaaggagtgtcgggaatggcgaccaagcggctcgcgcggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcagactgggacttgggggtttgcctggagtatgagtgtaaaagaaaacagctgttaaaacctgtgtttttaaattcttggattgatctcagagcaacttacaagcttttctataggagaaaaccaaaaggactaagtggtgccttgcaggaagtaggaatagaattctcaggacgagaacattctgggttggacgattctcggaatactgcccttcttgcttggaaaatgatcagagatggttgtgtaatgaaaattacaaggtcgttgaacaagggtcccttcctcttgccttcgtggacctggaacagtgatctggcctcaggggaccagcatgcttttcttcagcaagaatttgggtatttcttcaatttcttgtcttttggattactattcaggacaaccaatctctcaagaaagggtcaagtacctatcctagctgtggaacctacagaaccttacttcagaagcccaatatgagtaaacaggaaaaggggaatattctctggttgacaatggtgtggctgtcactggcatgtctgcaaaggaaaaactacaatgactgcatgttaaacacagcatcacagactgttaccactgaaaaattttgagaagctctccacttgaacctcttcatgtcatgaatcaggtgccagtggcttagcttgaattacagggtaaaagccatcactttctctatccttttaggtgctttctagaatcaaaactaaactttgtcatcaaaggcccatttataatagctgctttcctagctttttattctatgataaagaaggattgaagcatttttaaaacttgagatttttatcatacctccagcagagtaaggagtctgtgtgatcttgcaatcatggataaggaagaattttccccttccctcccctatggatgctttaaaatgtgattttttaaaaatgagtatgttaatacaatacatgttagtaaaagccatgggtactgatgggccaacacactacagcctactggcaaaatctgacttgcctcttgtttctgtaaataaaatgttattgcccattcattga

SEQ ID NO: 279291 - DNA, 1795 bp, Homo sapiens
gcgacttccggcagctggacttggaaaagcaaggagtgtcgggaatggcgaccaagcggctcgcgcgaaagggtacactcgccagcagttttgccaggagagtacactgaacaaaggagacagggtcatttataacgtggcgcgtccaccctactgctgtgtccggtttcctttggctggaacgggacctcacattctgtatttgtcccgactgactagcaacatagaactttttaaaagaggcaaaggcagaggagaacaaaggaagaaggaagtaacttgtggaatgctgagaaaggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcagactgggacttgggggtttgcctggagtatgagtgtaaaagaaaacagctgttaaaacctgtgtttttaaattcttggattgatctcagagcaacttacaagcttttctataggagaaaaccaaaaggactaagtggtgccttgcaggaagtaggaatagaattctcaggacgagaacattctgggttggacgattctcggaatactgcccttcttgcttggaaaatgatcagagatggttgtgtaatgaaaattacaaggtcgttgaacaagggtcccttcctcttgccttcgtggacctggaacagtgatctggcctcaggggaccagcatgcttttcttcagcaagaatttgggtatttcttcaatttcttgtcttttggattactattcaggacaaccaatctctcaagaaagggtcaagtacctatcctagctgtggaacctacagaaccttacttcagaagcccaatatgagtaaacaggaaaaggggaatattctctggttgacaatggtgtggctgtcactggcatgtctgcaaaggaaaaactacaatgactgcatgttaaacacagcatcacagactgttaccactgaaaaattttgagaagctctccacttgaacctcttcatgtcatgaatcaggtgccagtggcttagcttgaattacagggtaaaagccatcactttctctatccttttaggtgctttctagaatcaaaactaaactttgtcatcaaaggcccatttataatagctgctttcctagctttttattctatgataaagaaggattgaagcatttttaaaacttgagatttttatcatacctccagcagagtaaggagtctgtgtgatcttgcaatcatggataaggaagaattttccccttccctcccctatggatgctttaaaatgtgattttttaaaaatgagtatgttaatacaatacatgttagtaaaagccatgggtactgatgggccaacacactacagcctactggcaaaatctgacttgcctcttgtttctgtaaataaaatgttattgcccattcattga

SEQ ID NO: 279292 - DNA, 873 bp, Homo sapiens
gcgacttccggcagctggacttggaaaagcaaggagtgtcgggaatggcgaccaagcggctcgcgcggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcagactgggacttgggggtttgcctggagtatgagtgtaaaagaaaacagctgttaaaacctgtgtttttaaattcttggattgatctcagagcaacttacaagcttttctataggagaaaaccaaaaggactaagtggtgccttgcaggaagtaggaatagaattctcaggacgagaacattctgggttggacgattctcggaatactgcccttcttgcttggaaaatgatcagagatggttgtgtaatggccagaaatttgaatacaattcaagttgaagaaatgtctgcctgtaacattagcatccagggtcccagcatatataataaggagcctaaaaatataataaatcctcatgaaaaagttcaaa

SEQ ID NO: 279293 - DNA, 2900 bp, Homo sapiens
tgtgtcaggtgtccccagactactgaaatactgattttattttgcgcctcacatgttgcgtatgccatcaggttacctgcaaggctgagttttaactctgaactggttcactctttcagaaacatctttagcctagtacccttctgctcagtcttttgttttcacagcagtacagtttttaccttgcataactgacattgtctgaaaaagaagacatatactataattgcatagttttgttttgtgaaaccagcagacattttttggtattagaaatcataggatctcccctctaatctcaatttactgttttgttttttttttttaaactttgtcgtcatgagaaaaatcatttttttatgaatgcctatattgcttctcactatttactgagaaacactaggcaaaaggaatgatacagttttaaaatgtttgaaatctctgtgagtagctcagaaatttttctggaaaaggtagatgtacacatttgcatttactccctcaggtcctctgccctgacacagtatatttcacctgttctccttctagctcttgctccccttatggacagcactattattgtgtgtcttgatagatgtccccctacccccagaactggcagacagtgttggaatgcgggcgttgatagtgggccaggcttcgcagaatgtctaaaaagggaatgtgtacatgaagttttttgggggaagaggagctagagcaagttaatctgcttgtttctctagaatcatttaaaggtaacctctgaattgggaagggaggttgtagttggcagggagttttccatttaataggcttaatttcctaagcctgactgaagaaatactgtctttcctttttctgcagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgtacacatttcagtataataaatgttttctgattgttttgcaaa

SEQ ID NO: 279294 - DNA, 3780 bp, Homo sapiens
agtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagatgaggcttgagcctataattgaagatgcagttgaacatgagcagaaaaagtccagcaagcggactttgccagcagactacggtgattctctggcaaagcgaggcagttgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgtacacatttcagtataataaatgttttctgattgttttgcaaa

SEQ ID NO: 279295 - DNA, 3316 bp, Homo sapiens
tcggtaccaccactcctatagatcagtggaaaattagtaaagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagatgaggcttgagcctataattgaagatgcagttgaacatgagcagaaaaagtccagcaagcggactttgccagcagactacggtgattctctggcaaagcgaggcagttgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgtacacatttcagtataataaatgttttctgattgttttgcaaa

SEQ ID NO: 279296 - DNA, 3806 bp, Homo sapiens
agtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagtgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaagggcaggcccagatatgatgcaggcactgatgagggcagaggtagactgtaagactggtagaaatgcacatgggcagtactgatttcttgaagacgactgggtttgttgccaagaaaacaaaacttctaatttaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgtacacatttcagtataataaatgttttctgattgttttgcaaa

SEQ ID NO: 279297 - DNA, 1158 bp, Homo sapiens
ggaatccactgttttctcactttcctcccatatctccgtccttcatccaaaaccttcccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgtacacatttcagtataataaatgttttctgattgttttgcaaa

SEQ ID NO: 279298 - DNA, 3706 bp, Homo sapiens
agtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagatgaggcttgagcctataattgaagatgcagttgaacatgagcagaaaaagtccagcaagcggactttgccagcagactacggtgattctctggcaaagcgaggcagttgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaa

SEQ ID NO: 279299 - DNA, 2374 bp, Homo sapiens
agtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagatgaggcttgagcctataattgaagatgcagttgaacatgagcagaaaaagtccagcaagcggactttgccagcagactacggtgattctctggcaaagcgaggcagttgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgacagggtcccaccggtattcacattcttgttagtgatcagatggttcagaattttcaagatgagagttgttttttattctccacagtaaaaggtactttgcatgtgtgtgtgtcttaaaatgctggaatcatgagagatggtgtgtgcctctaattagtgcctctcgtgtttattctttaaaatgattgctttactcattttaagaagaaagtttgataaatgagaatatttctagtggttgtaacagaaattagcatataaggaagaggagtcagtctttctagatgactggaaaaaaaaatctcaattcattcagccaacgtcttactgagcactttgtgtcagacaccgtgcttctgtcgctcagtggatctattgaataaaacagaatccatgaaactcctattggggaaagcaaaccaaaattggccaagagatacacaaaattcccaatatgttaagttccatgaaggaacaggaaagtgtgggggtacttatggataagggagatctgggttgaggggaatatgaaactgtaaggcaaggcttctctgaggaggtgttattaatcctgagacttgaagaatgagaagaagcgggagctggccattggattagcatccccaggcaacgtggggctgtgtgcaaagaaaacacctggcttcttggaaagcctggcagtgggccatgtaggtgccatgcagtgtgtgagggtgagcggatcagggcaaatcaaagcaggagcacagatgcagtcggtaagcctgcttcc

SEQ ID NO: 279300 - DNA, 2454 bp, Homo sapiens
agtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagtgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaagggcaggcccagatatgatgcaggcactgatgagggcagaggtagactgtaagactggtagaaatgcacatgggcagtactgatttcttgaagacgactgggtttgttgccaagaaaacaaaacttctaatttaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaaggtactttgcatgtgtgtgtgtcttaaaatgctggaatcatgagagatggtgtgtgcctctaattagtgcctctcgtgtttattctttaaaatgattgctttactcattttaagaagaaagtttgataaatgagaatatttctagtggttgtaacagaaattagcatataaggaagaggagtcagtctttctagatgactggaaaaaaaaatctcaattcattcagccaacgtcttactgagcactttgtgtcagacaccgtgcttctgtcgctcagtggatctattgaataaaacagaatccatgaaactcctattggggaaagcaaaccaaaattggccaagagatacacaaaattcccaatatgttaagttccatgaaggaacaggaaagtgtgggggtacttatggataagggagatctgggttgaggggaatatgaaactgtaaggcaaggcttctctgaggaggtgttattaatcctgagacttgaagaatgagaagaagcgggagctggccattggattagcatccccaggcaacgtggggctgtgtgcaaagaaaacacctggcttcttggaaagcctggcagtgggccatgtaggtgccatgcagtgtgtgagggtgagcggatcagggcaaatcaaagcaggagcacagatgcagtcggtaagcctgcttcc

SEQ ID NO: 279301 - DNA, 266 bp, Homo sapiens
agtaggatgtacacatttcagtataataaatgttttctgattgttttgcaaatgtgtgtctcatttaaaatcccagttcctgctactgtcacttcgtgtcatagaatcaaggagtttccctgtgtgtattctgagccagtctaaatgtagtaagaggttaggctcatagttttttccttttcagtttattttctgaaagctgatgcaactgaggatatgttgttattccattaactaactaactaactaactaactaactaaacta

SEQ ID NO: 279302 - DNA, 249 bp, Homo sapiens
tgagggcagaggtagactgtaagactggtagaaatgcacatgggcagtactgatttcttgaagacgactgggtttgttgccaagaaaacaaaacttctaatttaggtgagctatacagaatctatggttttcaaggtcatgactattactaaacagttattaaaaatgtaaactaattgtgaattaaaatgacagaaactgtaaattgtgctggcttgtaagaaccatttactatcattgctctttcta

SEQ ID NO: 279303 - DNA, 634 bp, Homo sapiens
gtttgacatgttattctctgtgaaatttctggggaaaatatttaaatttggggattttgatagactgtttcctgggtgggatcttaaatgaagatgctgaaatcccaatgaggtcttagaaacagaccttaaaaactttgaagttggcaagagacttaagttggagcctagaaagtccaatttttgtcactgctggggttttgcattttttttaactttgaatcctgttagtcatgcatttgtttaattggactgaagagacatgaaacagggtgttagatctttctttgtataatgaaaagacattgatcccaatctttggtgtttgtccagatgaggcttgagcctataattgaagatgcagttgaacatgagcagaaaaagtccagcaagcggactttgccagcagactacggtgattctctggcaaagcgaggcagtgtaagggacttctgcttctcttttcattgtgcaagaaaccttgtgcagtgttagatataggaccaacttccaccgcaaagtaaagccaaaattgtttttgatgtccatgtcttgatttaatttgcttttgtttagacttcctgcttctgtttgttcctcactgaggaaaatttcctaaatctaacactttaaa

SEQ ID NO: 279304 - DNA, 396 bp, Homo sapiens
tctattgaataaaacagaatccatgaaactcctattggggaaagcaaaccaaaattggccaagagatacacaaaattcccaatatgttaagttccatgaaggaacaggaaagtgtgggggtacttatggataagggagatctgggttgaggggaatatgaaactgtaaggcaaggcttctctgaggaggtgttattaatcctgagacttgaagaatgagaagaagcgggagctggccattggattagcatccccaggcaacgtggggctgtgtgcaaagaaaacacctggcttcttggaaagcctggcagtgggccatgtaggtgccatgcagtgtgtgagggtgagcggatcagggcaaatcaaagcaggaggccgggtctggcatgcggggacc

SEQ ID NO: 279305 - DNA, 594 bp, Homo sapiens
ttttttggtactttgaaaggtgtgaccttcgtacagatcctacagatcaggcagaaaacagatcaaagattactgttaaaatgcttttctttttttttttttaatttcagtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcaggtaaatcaaatcatttgtttttccttttcagactggtatttacttttatacatgtaattgtagaactgtagaaaaattctgtgacctcttttgaaaatacttatgagaatcattttcagagagttgggaatcactttggaagaacttataaccaagagtttcaggcatcctagtgataatatggaatacaagccaaggaaaactggcttagcctccccccagccctttaggatgcagccaatcactggggcactctagggatagtggcaggctttggccctttttatgaggtgagtcactggatgtgttttccttttgtctattatttgatgactaattta

SEQ ID NO: 279306 - DNA, 3672 bp, Homo sapiens
agtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagtgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgtacacatttcagtataataaatgttttctgattgttttgcaaa

SEQ ID NO: 279307 - DNA, 3726 bp, Homo sapiens
agtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagatgaggcttgagcctataattgaagatgcagttgaacatgagcagaaaaagtccagcaagcggactttgccagcagactacggtgattctctggcaaagcgaggcagttgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgtacacatttcagtataataaatgttttctgattgttttgcaaa

SEQ ID NO: 279308 - DNA, 4269 bp, Homo sapiens
  misc_feature (3792)..(3792): n is a, c, g, or t
  misc_feature (3797)..(3797): n is a, c, g, or t
  misc_feature (3803)..(3803): n is a, c, g, or t
agtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagatgaggcttgagcctataattgaagatgcagttgaacatgagcagaaaaagtccagcaagcggactttgccagcagactacggtgattctctggcaaagcgaggcagttgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgtacacatttcagtataataaatgttttctgattgttttgcaaaaaaaaaaaaaanaaaanaaaaanaaaaaaaaaaaaaaaaaaaaaaaaggggggggggggtaaaaaatactccccgcgaagggggccccacgatttatccgctgctgccccggttctttctgttgaacacaaggggggcccccataagaggaggagggcagtaataatagaaagcaggggagcagagggggcggggagtataaaacaaacccggcgcggggcgcggggagaagaaccggtggtctccgcgggggacctcttcgggagagagaggaaccccctcatccttctgggggggcggcgacacccatctcggggggcaccaacccctcccaaggaagaatattaacaggccccagaagggagaaaacttattacaactccagcgcggtgcactactggcggcaacaccaacacgcgggctattatctcgggcgcgggtagagaaaactccggcccacgggaggtgtactcgcaaaatatataggcg

SEQ ID NO: 279309 - DNA, 4195 bp, Homo sapiens
  misc_feature (3718)..(3718): n is a, c, g, or t
  misc_feature (3723)..(3723): n is a, c, g, or t
  misc_feature (3729)..(3729): n is a, c, g, or t
agtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagatgaggcttgagcctataattgaagatgcagttgaacatgagcagaaaaagtccagcaagcggactttgccagcagactacggtgattctctggcaaagcgaggcagttgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaaaaaaaaaaaaanaaaanaaaaanaaaaaaaaaaaaaaaaaaaaaaaaggggggggggggtaaaaaatactccccgcgaagggggccccacgatttatccgctgctgccccggttctttctgttgaacacaaggggggcccccataagaggaggagggcagtaataatagaaagcaggggagcagagggggcggggagtataaaacaaacccggcgcggggcgcggggagaagaaccggtggtctccgcgggggacctcttcgggagagagaggaaccccctcatccttctgggggggcggcgacacccatctcggggggcaccaacccctcccaaggaagaatattaacaggccccagaagggagaaaacttattacaactccagcgcggtgcactactggcggcaacaccaacacgcgggctattatctcgggcgcgggtagagaaaactccggcccacgggaggtgtactcgcaaaatatataggcg

SEQ ID NO: 279310 - DNA, 1268 bp, Homo sapiens
agtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagtggcatgtcagggcccaggtgctgctgggccctcagtgtggaggggcattctattggaaagacctgccctctgtggatctgcctttttagtggagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagcaatggtatgatcatggctcactgtagactttaactacgtggctgaagctgtcctctcactccagtttccacccttacacaccagtagctgggattacagacactcaccagcgcgcctggctaatttttattatttgtagaaactgagggtctcactggtgttgcccaggctggtctcgaagctcctggcctcagacatcctgggattacaggtgggagtcactgttgcctgacagcattgtatagtaggaagtgactaaagac

SEQ ID NO: 279311 - DNA, 517 bp, Homo sapiens
gtccaggcaggtcccctggggcagctgcccacccgtgccccggggatgatgtctcagtttacccagagttccagccccaggctgctgggtgaccgcggagagaggaatgcggccatccgtgacatttttgggacatggatctctgccccacctcacatcacctctgatagcaccgctcagccggggagccagaaccgcacccccactgcaccctagagagtattgcaagcagagatggcaagtccaagcgtgcacaggcagaggcttgcaggaaactgacccctggccgcttatctggtgttccggctctcaagcacaaagccaggcatgggctctgcatccccacccattgaggggagccaggacagaaagaagcccacaagtaacccaggtgtatttgtctgttctcatgctgctaataaacacatacccgagactgggtaatttataaagggaaaaggtttaatggactcatagttccacgtggctggttggtggttggcagggttgcgggggc

SEQ ID NO: 279312 - DNA, 383 bp, Homo sapiens
tgggtgatgggggtcatcaccccctcaacccccgtgtccctgttccccatttagccagaaccgcacccccactgcaccctagagagtattgcaagcagagatggcaagtccaagcgtgcacaggcagaggcttgcaggaaactgacccctggccgcttatctggtgttccggctctcaagcacaaagccaggcatgggctctgcatccccacccattgaggggagccaggacagaaagaagcccacaagtaacccaggtgtatttgtctgttctcatgctgctaataaacacatacccgagactgggtaatttataaagggaaaaggtttaatggactcatagttccacgtggctggttggtggttggcagggttgcgggggc

SEQ ID NO: 279313 - DNA, 1753 bp, Homo sapiens
ctccgacgtcatcggggcgcgccctcgcgctgtcgccgccacagtctgcgacgggacccggcgtgcccatgtgtcaggtgggcgaggactacggggagccggcgcctgaggagccgcccccggcgccgcggcccagccgtgagcagaagtgtgtgaagtgcaaggaagcgcagcccgttgtggtgatacgagccggagatgccttctgcagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccggatgcagtcacccatccccctgactgagacccggacacccccggggccctgctgttctccaggggtgggctgggcccagcgctgcggccagggggcctgcaggagggaggacccccaagcctgcattgaggagcagctgtgctacagctgccgcgtgaacatgaaggacttgccctcactggaccccctgccgccgtacatcctggctgaggcccagctccgcacacagagggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaattaaaaaaaaaaaa

SEQ ID NO: 279314 - DNA, 1943 bp, Homo sapiens
  misc_feature (1711)..(1711): n is a, c, g, or t
  misc_feature (1723)..(1725): n is a, c, g, or t
  misc_feature (1730)..(1730): n is a, c, g, or t
  misc_feature (1737)..(1737): n is a, c, g, or t
  misc_feature (1752)..(1752): n is a, c, g, or t
  misc_feature (1757)..(1757): n is a, c, g, or t
  misc_feature (1760)..(1760): n is a, c, g, or t
  misc_feature (1766)..(1766): n is a, c, g, or t
  misc_feature (1826)..(1826): n is a, c, g, or t
  misc_feature (1853)..(1853): n is a, c, g, or t
ctccgacgtcatcggggcgcgccctcgcgctgtcgccgccacagtctgcgacgggacccggcgtgcccatgtgtcaggtgggcgaggactacggggagccggcgcctgaggagccgcccccggcgccgcggcccagccgtgagcagaagtgtgtgaagtgcaaggaagcgcagcccgttgtggtgatacgagccggagatgccttctgcagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccggatgcagtcacccatccccctgactgagacccggacacccccggggccctgctgttctccaggggtgggctgggcccagcgctgcggccagggggcctgcaggagggaggacccccaagcctgcattgaggagcagctgtgctacagctgccgcgtgaacatgaaggacttgccctcactggaccccctgccgccgtacatcctggctgaggcccagctccgcacacagagggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactgcttgatgtcatngataataacatnnntatanaaaaaanaaaactgaggggccngaccnatngctaangagcgtacaatactgcgcgttacagcggctgaacactcgtccactatgctgagcaccttngcagtggaatcaagccacatgctcaantgacgatgatgcataggatttaatcgaatgaaactttacaagatcgaactatagaacgaaggggctgaagctaaagcccgcgtggtgacg

SEQ ID NO: 279315 - DNA, 1696 bp, Homo sapiens
ctccgacgtcatcggggcgcgccctcgcgctgtcgccgccacagtctgcgacgggacccggcgtgcccatgtgtcaggtgggcgaggactacggggagccggcgcctgaggagccgcccccggcgccgcggcccagccgtgagcagaagtgtgtgaagtgcaaggaagcgcagcccgttgtggtgatacgagccggagatgccttctgcagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccggatgcagtcacccatccccctgactgagacccggacacccccggggccctgctgttctccaggggtgggctgggcccagcgctgcggccagggggcctgcaggagggaggacccccaagcctgcattgaggagcagctgtgctacagctgccgcgtgaacatgaaggacttgccctcactggaccccctgccgccgtacatcctggctgaggcccagctccgcacacagagggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaattaaaaaaaaaaaa

SEQ ID NO: 279316 - DNA, 1828 bp, Homo sapiens
ctccgacgtcatcggggcgcgccctcgcgctgtcgccgccacagtctgcgacgggacccggcgtgcccatgtgtcaggtgggcgaggactacggggagccggcgcctgaggagccgcccccggcgccgcggcccagccgtgagcagaagtgtgtgaagtgcaaggaagcgcagcccgttgtggtgatacgagccggagatgccttctgcagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccggatgcagtcacccatccccctgactgagacccggacacccccggggccctgctgttctccaggggtgggctgggcccagcgctgcggccagggggcctgcaggagggaggacccccaagcctgcattgaggagcagctgtgctacagctgccgcgtgaacatgaaggacttgccctcactggaccccctgccgccgtacatcctggctgaggcccagctccgcacacagaggtactggggcccacactgccgtggcgcgtgggtaaggggcctcggggctggtgcccactgcagctttctctctagggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaattaaaaaaaaaaaa

SEQ ID NO: 279317 - DNA, 1650 bp, Homo sapiens
aatcaggctaggtacgaggctgggtggcgccggcgtgcccatgtgtcaggtgggcgaggactacggggagccggcgcctgaggagccgcccccggcgccgcggcccagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccggatgcagtcacccatccccctgactgagacccggacacccccggggccctgctgttctccaggggtgggctgggcccagcgctgcggccagggggcctgcaggagggaggacccccaagcctgcattgaggagcagctgtgctacagctgccgcgtgaacatgaaggacttgccctcactggaccccctgccgccgtacatcctggctgaggcccagctccgcacacagagggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaattaaaaaaaaaaaa

SEQ ID NO: 279318 - DNA, 787 bp, Homo sapiens
gagtgggtgtgggggctcagcagccccaggctccgtcaccccctctctgcttgcagacagtgccacggcttttggggctcagacctcctcgcgtctctcccggatgcagtcacccatccccctgactgagacccggacacccccggggccctgctgttctccaggggtgggctgggcccagcgctgcggccagggggcctgcaggaggtgagtccctgtccctgccacccatggccagctgcatggggcgggagggggacctgtccttaccccacactgcacggcactgaggtgccaaggtgggcacacagccagctctgctcccgcagggaggacccccaagcctgcattgaggagcagctgtgctacagctgccgcgtgaacatgaaggacttggtgagtacgtgcccacctgtcctgggccgggcttggggacgcgggaaggctgtcgtcaccctcgtgggtggcttgagggggtgctggcgggtttcttggcccctcgacaccggcctctgttgcagccctcactggaccccctgccgccgtacatcctggctgaggcccagctccgcacacagagggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaattaaaaaaaaaaaa

SEQ ID NO: 279319 - DNA, 1725 bp, Homo sapiens
aatcaggctaggtacgaggctgggtggcgccggcgtgcccatgtgtcaggtgggcgaggactacggggagccggcgcctgaggagccgcccccggcgccgcggcccagccgtgagcagaagtgtgtgaagtgcaaggaagcgcagcccgttgtggtgatacgagccggagatgccttctgcagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccggatgcagtcacccatccccctgactgagacccggacacccccggggccctgctgttctccaggggtgggctgggcccagcgctgcggccagggggcctgcaggagggaggacccccaagcctgcattgaggagcagctgtgctacagctgccgcgtgaacatgaaggacttgccctcactggaccccctgccgccgtacatcctggctgaggcccagctccgcacacagagggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaattaaaaaaaaaaaa

SEQ ID NO: 279320 - DNA, 2000 bp, Homo sapiens
ctccgacgtcatcggggcgcgccctcgcgctgtcgccgccacagtctgcgacgggacccggcgtgcccatgtgtcaggtgggcgaggactacggggagccggcgcctgaggagccgcccccggcgccgcggcccagccgtgagcagaagtgtgtgaagtgcaaggaagcgcagcccgttgtggtgatacgagccggagatgccttctgcagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccggatgcagtcacccatccccctgactgagacccggacacccccggggccctgctgttctccaggggtgggctgggcccagcgctgcggccagggggcctgcaggaggtgagtccctgtccctgccacccatggccagctgcatggggcgggagggggacctgtccttaccccacactgcacggcactgaggtgccaaggtgggcacacagccagctctgctcccgcagggaggacccccaagcctgcattgaggagcagctgtgctacagctgccgcgtgaacatgaaggacttggtgagtacgtgcccacctgtcctgggccgggcttggggacgcgggaaggctgtcgtcaccctcgtgggtggcttgagggggtgctggcgggtttcttggcccctcgacaccggcctctgttgcagccctcactggaccccctgccgccgtacatcctggctgaggcccagctccgcacacagagggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaattaaaaaaaaaaaa

SEQ ID NO: 279321 - DNA, 1694 bp, Homo sapiens
ataggctagatagagacgggcgttaatcgagacgagggggagcggcgcctgaggagccgccccggcgccgcggccagccgtgagcagaagtgtgtgaagtgcaaggaagcgcagcccgttgtggtgatacgagccggagatgccttctgcagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccggatgcagtcacccatccccctgactgagacccggacacccccggggccctgctgttctccaggggtgggctgggcccagcgctgcggccagggggcctgcaggagggaggacccccaagcctgcattgaggagcagctgtgctacagctgccgcgtgaacatgaaggacttgccctcactggaccccctgccgccgtacatcctggctgaggcccagctccgcacacagagggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaattaaaaaaaaaaaa

SEQ ID NO: 279322 - DNA, 1950 bp, Homo sapiens
aatcaggctaggtacgaggctgggtggcgccggcgtgcccatgtgtcaggtgggcgaggactacggggagccggcgcctgaggagccgcccccggcgccgcggcccagccgtgagcagaagtgtgtgaagtgcaaggaagcgcagcccgttgtggtgatacgagccggagatgccttctgcagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgaacgaactcctggggtgttgactgtagcgctgaggtcagccgcaagagagaaacccctgcccacacggcacacatggcgaaaccaccacagctccgccatggaagcaccgacctgcggagacgaggcctcgaacgggtaaacccaggtggcagatggccctgacagcctgccctgacatggatcctctcatgagccctgactctttctgcctgcggtcatcacagagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccggatgcagtcacccatccccctgactgagacccggacacccccggggccctgctgttctccaggggtgggctgggcccagcgctgcggccagggggcctgcaggagggaggacccccaagcctgcattgaggagcagctgtgctacagctgccgcgtgaacatgaaggacttgccctcactggaccccctgccgccgtacatcctggctgaggcccagctccgcacacagagggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaattaaaaaaaaaaaa

SEQ ID NO: 279323 - DNA, 902 bp, Homo sapiens
gtcccccgcgcgggcgcgggtggatctctcgggctctgacttgttttcgggtcaccttcaggcttcagccaggcacctgacgcctctttcccctcacggtgccaggccgggccgaactacatttcccaggaggctccgcggccaggtgcaaacagcgccgtgctgactacatttcccagacagccttgcggcggcccgggccttaaagcgtccatttcccagcggccctccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcaggcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtgaaaaaaaaaaaaaaaaaa

SEQ ID NO: 279324 - DNA, 1023 bp, Homo sapiens
gtcccccgcgcgggcgcgggtggatctctcgggctctgacttgttttcgggtcaccttcaggcttcagccaggcacctgacgcctctttcccctcacggtgccaggccgggccgaactacatttcccaggaggctccgcggccaggtgcaaacagcgccgtgctgactacatttcccagacagccttgcggcggcccgggccttaaagcgtccatttcccagcggccctccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcaggcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtgaaaaaaaaaaaaaaaaaaaaaaaaaaaaaaaaaaaagggggggggggcaaaaaaaaacccccggggggcccacataggacaaccccgtttttgggaaaaagggggcccaaaaaggggggcaataaaaaaaaaaggcagg

SEQ ID NO: 279325 - DNA, 1030 bp, Homo sapiens
gtcccccgcgcgggcgcgggtggatctctcgggctctgacttgttttcgggtcaccttcaggcttcagccaggcacctgacgcctctttcccctcacggtgccaggccgggccgaactacatttcccaggaggctccgcggccaggtgcaaacagcgccgtgctgactacatttcccagacagccttgcggcggcccgggccttaaagcgtccatttcccagcggccctccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcaggctggtatggtggcgcacttgtagtcccagctacttgggaggctgaggcaagagaatcgcttgaacccaggaggcgaaggttgcagtgagccgagattgcactactgcactccagcctgggagacagagcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtgaaaaaaaaaaaaaaaaaa

SEQ ID NO: 279326 - DNA, 583 bp, Homo sapiens
agagagtagagagagagagagagagatagagagagactcgtgccgaattcggcacgaggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtaaaaaaaaaaaaaaaaaaaaaaataaaaaaaaaaaaaacaaacctttttcaggttggtattaaattcaaagaggctcgtgttaaaaaccctttgaatccgaaattcagttcgtttggcacattactcctttttaaccaatcgctttttccaaattggccttaaatctttgtggcctcaactaattgcatttccaaaagggcgtagtccctcaatggccttattaattttgagaatttccctattagggttttgtgttgtcacattttgtaaacaaagtcattttttacgcttgccttattaccttggcttttctttggttgggc

SEQ ID NO: 279327 - DNA, 300 bp, Homo sapiens
gcggccgcctactactactactactgctcgaattcaagcttctaacgatgtacgggcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtgaaaaaaaaaaaaaaaaaa

SEQ ID NO: 279328 - DNA, 3556 bp, Homo sapiens
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtgggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaacc

SEQ ID NO: 279329 - DNA, 3811 bp, Homo sapiens
  misc_feature (3798)..(3798): n is a, c, g, or t
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279330 - DNA, 3294 bp, Homo sapiens
  misc_feature (3236)..(3236): n is a, c, g, or t
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtnacacaaacaaacaacaaaaaaaggggggcggaaaaaaacccagggggccaacaacgac

SEQ ID NO: 279331 - DNA, 3742 bp, Homo sapiens
  misc_feature (3729)..(3729): n is a, c, g, or t
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279332 - DNA, 3782 bp, Homo sapiens
  misc_feature (3769)..(3769): n is a, c, g, or t
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279333 - DNA, 3874 bp, Homo sapiens
  misc_feature (3861)..(3861): n is a, c, g, or t
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggcccaggcagggctgaccctgactctgcccccaggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtttgggccagaactggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279334 - DNA, 3264 bp, Homo sapiens
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtttgggccagaactggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagt

SEQ ID NO: 279335 - DNA, 3064 bp, Homo sapiens
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggcgtgatgcagtcgcggcgttgacgcagtc

SEQ ID NO: 279336 - DNA, 3889 bp, Homo sapiens
  misc_feature (3876)..(3876): n is a, c, g, or t
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtggggggcctgtctggggcctgggcttgctggggagggtaagcggccagtcccccagcaccttgccgccgcccccaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279337 - DNA, 3526 bp, Homo sapiens
  misc_feature (22)..(22): n is a, c, g, or t
  misc_feature (30)..(30): n is a, c, g, or t
  misc_feature (36)..(36): n is a, c, g, or t
  misc_feature (3513)..(3513): n is a, c, g, or t
aggctaggtcgaggctgggttnaatcggcngagggnctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279338 - DNA, 2965 bp, Homo sapiens
  misc_feature (22)..(22): n is a, c, g, or t
  misc_feature (30)..(30): n is a, c, g, or t
  misc_feature (36)..(36): n is a, c, g, or t
  misc_feature (2952)..(2952): n is a, c, g, or t
aggctaggtcgaggctgggttnaatcggcngagggngcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279339 - DNA, 3013 bp, Homo sapiens
  misc_feature (25)..(25): n is a, c, g, or t
  misc_feature (3000)..(3000): n is a, c, g, or t
agagcgtattactataggtcgagtncctggttttactttcgtcacggagggcctaggcctcctgcagtgaaagtaaatgggccggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279340 - DNA, 3009 bp, Homo sapiens
  misc_feature (2996)..(2996): n is a, c, g, or t
ccagcgaactattactagctacgatcaccgcttttatttcagtcacgaggcctaggccccgcagtgaagtaacatgcgcggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279341 - DNA, 4109 bp, Homo sapiens
  misc_feature (4096)..(4096): n is a, c, g, or t
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtgcgtgcggagaggcccggagaccccctaacccggcaatgccgtgtgcaagatgaagccgagccttccgggtcctaggatccccgagccaactcaggggccatcgccgtgatgctggccctgatggcacggacgggtccctcccacccacagccacgcccagcaggctgcccgtccaaggcagggtgtgggtgccgctctcactcggggtctccccagccctgaccctggggtctccccactgggcgggctggccaggggcacggcgaggggcaccacctgctgtctgctgccccaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279342 - DNA, 4187 bp, Homo sapiens
  misc_feature (4174)..(4174): n is a, c, g, or t
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtgcgtgcggagaggcccggagaccccctaacccggcaatgccgtgtgcaagatgaagccgagccttccgggtcctaggatccccgagccaactcaggggccatcgccgtgatgctggccctgatggcacggacgggtccctcccacccacagccacgcccagcaggctgcccgtccaaggcagggtgtgggtgccgctctcactcggggtctccccagccctgaccctggggtctccccactgggcgggctggccaggggcacggcgaggggcaccacctgctgtctgctgccccaggtggacaagatcggccgaggctaccagggggacccgtcgtcggcactgctggagctgctggacccagagcagaatgccaacttcctggaccactacctggacgtgcccgtggacttgtccaaggtggggggcctgtctggggcctgggcttgctggggagggtaagcggccagtcccccagcaccttgccgccgcccccaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279343 - DNA, 3321 bp, Homo sapiens
  misc_feature (3308)..(3308): n is a, c, g, or t
tcctgggttcacgccattctcctgcctcagcctcccgagtagctgggactacaggcgcccgccatcacgcccgcctaatttttgtattttttggtagagacggggtttcactgtgttagccaggagggtctcgatctcctgacctcatgatccacccgcctcggcctcccaaagtgcttggattacaggcgtgagccaccacgcccggccaagacttggtctcttaaaaaatggaggaaagaaaacacagtctctttttttcccctgagatagcttatcctaaggacaaggctctgaggggtaaggagacagggtttggttttagttttgactctcttggtcctgtgtccctgggactggtgagtccaccagggactgcactcctccatctcccaggccgtccgtggccagggccagttggcggaggggagggagttgatggagctggtgggtggggctcccagggccatgctcccacccagcccaccccctgctggagcactgctgggccccagcgaccctgccccatacttggcaggccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279344 - DNA, 3001 bp, Homo sapiens
  misc_feature (2988)..(2988): n is a, c, g, or t
aattttttatttttatgggctttagcgatggaggtaggattggtgctgtgggtgaaagagtatgatggggggcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggtgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279345 - DNA, 2500 bp, Homo sapiens
  misc_feature (2487)..(2487): n is a, c, g, or t
ggacgcgtgggtcccccacgacttcgaccttgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279346 - DNA, 3299 bp, Homo sapiens
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtgcgtgcggagaggcccggagaccccctaacccggcaatgccgtgtgcaagatgaagccgagccttccgggtcctaggatccccgagccaactcaggggccatcgccgtgatgctggccctgatggcacggacgggtccctcccacccacagccacgcccagcaggctgcccgtccaaggcagggtgtgggtgccgctctcactcggggtctccccagccctgaccctggggtctccccactgggcgggctggccaggggcacggcgaggggcaccacctgctgtctgctgccccaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagt

SEQ ID NO: 279347 - DNA, 1675 bp, Homo sapiens
  misc_feature (1608)..(1608): n is a, c, g, or t
  misc_feature (1623)..(1623): n is a, c, g, or t
  misc_feature (1662)..(1662): n is a, c, g, or t
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctgactgcgcgccaggcangctgagaaacctcgnatgagctcagaacctctgagtatgcgtgcagtcgggtcncaggagacttgtt

SEQ ID NO: 279348 - DNA, 1561 bp, Homo sapiens
  misc_feature (1548)..(1548): n is a, c, g, or t
tgtggctggcagctgctgggggctgccctgtggggcgtacagagccaggaacccgcaacgcagcaaacgtagaggccagcgttggctcacgatgggacaccaacccctgcccaggggcaccaagatgctaaactggggcaggagcggtcagagtggccccgaggggtggagtgagcaccggcctgggctccgaggcctcccgtgttcacagctccacacctgtttcaggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279349 - DNA, 1096 bp, Homo sapiens
gtcccccgcgcgggcgcgggtggatctctcgggctctgacttgttttcgggtcaccttcaggcttcagccaggcacctgacgcctctttcccctcacggtgccaggccgggccgaactacatttcccaggaggctccgcggccaggtgcaaacagcgccgtgctgactacatttcccagacagccttgcggcggcccgggccttaaagcgtccatttcccagcggccctccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgcgagcccttggcgttcagttcgcggtgtcagcctccgcctccgagcctcagttgtcttctctgtgaggtgggaatgccggtgaatcctgccgctggcgtggatgagaagtgaatgcgtgctcggagctgcgagtgacagcgggcaggaggcgcccagggacacttggtttctccagggctggaaggcttctagaaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcaggcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtgaaaaaaaaaaaaaaaaaa

SEQ ID NO: 279350 - DNA, 1361 bp, Homo sapiens
gtcccccgcgcgggcgcgggtggatctctcgggctctgacttgttttcgggtcaccttcaggcttcagccaggcacctgacgcctctttcccctcacggtgccaggccgggccgaactacatttcccaggaggctccgcggccaggtgcaaacagcgccgtgctgactacatttcccagacagccttgcggcggcccgggccttaaagcgtccatttcccagcggccctccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcaggagggatctaaaagggaaaggaggccgagcacagtggctcacgcctgtaatcccagcactttgggaggctgaggtgggcggatcatctgaagtcaggagttcgagaccagcctgggcaacatggtgaaaccccatctctactaaaaatacaaaaattaaccgtgcgtggtggtgcacacctgtaatcccagctgctgcttgagaggctgaagcaggagaattgcttgaacccaggaggcagaggttgcagtgagccgaggttgcaccactgcactccagcctgggcgacagggcgagactccatctcaaaaaaataaaatacaaaaattagcctggtatggtggcgcacttgtagtcccagctacttgggaggctgaggcaagagaatcgcttgaacccaggaggcgaaggttgcagtgagccgagattgcactactgcactccagcctgggagacagagcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtgaaaaaaaaaaaaaaaaaa

SEQ ID NO: 279351 - DNA, 1661 bp, Homo sapiens
gtcccccgcgcgggcgcgggtggatctctcgggctctgacttgttttcgggtcaccttcaggcttcagccaggcacctgacgcctctttcccctcacggtgccaggccgggccgaactacatttcccaggaggctccgcggccaggtgcaaacagcgccgtgctgactacatttcccagacagccttgcggcggcccgggccttaaagcgtccatttcccagcggccctccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccaggtactacgggccgggaacgaggccagggtttggcgggtggtcagctctgggaggtccctccagccctgcacgatgttgtcctccatattgatgctgacctgattctccggcctgtcctcctccctccgcctctggggatgggctgctgagccttttcaccagttctttctgcccatctctttttcccagctcccagcccctccaaagatttactttcccatccgtgactcctggaatgcaggtaaggcacccagtttctttgcttggagggagacaccccagtctagcccctctccccacttcctggccattcctttctgtccatcctccttcctgcccgacacgtgtctcttagggatctaaaagggaaaggaggccgagcacagtggctcacgcctgtaatcccagcactttgggaggctgaggtgggcggatcatctgaagtcaggagttcgagaccagcctgggcaacatggtgaaaccccatctctactaaaaatacaaaaattaaccgtgcgtggtggtgcacacctgtaatcccagctgctgcttgagaggctgaagcaggagaattgcttgaacccaggaggcagaggttgcagtgagccgaggttgcaccactgcactccagcctgggcgacagggcgagactccatctcaaaaaaataaaatacaaaaattagcctggtatggtggcgcacttgtagtcccagctacttgggaggctgaggcaagagaatcgcttgaacccaggaggcgaaggttgcagtgagccgagattgcactactgcactccagcctgggagacagagcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtgaaaaaaaaaaaaaaaaaa

SEQ ID NO: 279352 - DNA, 748 bp, Homo sapiens
gtcccccgcgcgggcgcgggtggatctctcgggctctgacttgttttcgggtcaccttcaggcttcagccaggcacctgacgcctctttcccctcacggtgccaggccgggccgaactacatttcccaggaggctccgcggccaggtgcaaacagcgccgtgctgactacatttcccagacagccttgcggcggcccgggccttaaagcgtccatttcccagcggccctccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgcgagcccttggcgttcagttcgcggtgtcagcctccgcctccgagcctcagttgtcttctctgtgaggtgggaatgccggtgaatcctgccgctggcgtggatgagaagtgaatgcgtgctcggagctgcgagtgacagcgggcaggaggcgcccagggacacttggtttctccagggctggaaggcttctagaggattgattttgaagcaaaccctgcaactgctgtactctgggtaaccagggtgagtttctctgcctctgacctttttagttgatcttgtaggtcctgggtatccaagctgcacaggtctctgtcgccct

SEQ ID NO: 279353 - DNA, 323 bp, Homo sapiens
cgccattacattccagccagggcaacagaatgagactctgtctcaaaaaaaaaatctactctgcatttcactttggggtcattgtcatgctaggttaaaaataagaagttggttgagctgctgagaaggaaagttcgtctcgcccagccttatgtcggcgtctttctaaagagagatgacaggtaagtgtgatttttccttcattcccttgttgacggtgccctagagtccagctcaccacaagtcctactctgtactttgcacctttgacccctgaccccgaggaaaccagggaagacctccagaataaaggccagaagcca

SEQ ID NO: 279354 - DNA, 344 bp, Homo sapiens
ctgcacgtgaggatgctgcatgcctttccagcccaggacgggtgggccctgaactctggagaacaagcagcagagctggctcccagcgagcacccctagaccgtgcccatagctacaggggacagggaccctgaggaccgggtccccgtttgggggctgcactgcagcagagcgtgaggccctggccaccgaggcagctccctttgtcccccagggagtcagtgctgcagatgatgcaggctggccagcgggtggtggacaaccccatctacctgagcgacatgggcgccgcgctcaccggggccgagtcccatgagctgcaggacgtcctggaagagaccaat

SEQ ID NO: 279355 - DNA, 516 bp, Homo sapiens
tggtgggttttgggacttactgcttagaacccggcatcactgtgtatcgccggtccccaggaagccctttcgttcctggaggttagcacacctgctgccctcccacaggcccaggcagggctgaccctgactctgcccccaggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagt

SEQ ID NO: 279356 - DNA, 3181 bp, Homo sapiens
aattttttatttttatgggctttagcgatggaggtaggattggtgctgtgggtgaaagagtatgatggggggcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagt

SEQ ID NO: 279357 - DNA, 1058 bp, Homo sapiens
gtcccccgcgcgggcgcgggtggatctctcgggctctgacttgttttcgggtcaccttcaggcttcagccaggcacctgacgcctctttcccctcacggtgccaggccgggccgaactacatttcccaggaggctccgcggccaggtgcaaacagcgccgtgctgactacatttcccagacagccttgcggcggcccgggccttaaagcgtccatttcccagcggccctccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcaggcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtgaaaaaaaaaaaaaaaaaacttcgagactagttctctctctcctccaccattttacccagaaaaccttttgccaagacatttttctccaataaggtatggcgatagaattgaacccgggggccatagattttgtcccgcaggggaaggatgtaaattttttccagcgtatattag

SEQ ID NO: 279358 - DNA, 546 bp, Homo sapiens
aggaagggagaaaggagaggagagagagggtcgaagaggaggatgagacagagtgcaaaaagaggataagagagagagaaggaataaggagaggagaagagaggatgataagagaagaggagagtagaagagaaagggggaagtgaaatgtagaagggaggacgacaggcagactggcggtagtgcgagagaaggcgaggggaagggatgagtccgtggcaacagcatgcctcatgacgaccagagccatggtcaagcggctgacgctgcgacagcgcggatgtgcgtcggcaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccgaagacggccgt

SEQ ID NO: 279359 - DNA, 3925 bp, Homo sapiens
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgcggacagcgacggggagaaggggcggaggtgagtaccggctcagttcccgaggcccagagccccgcgtcccggctccttcagcctcgctcgccacaaccaaccatcctccaacctgcacagaggacccgggagtccggatggcggcggataccgg

SEQ ID NO: 279360 - DNA, 3688 bp, Homo sapiens
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtaaaaaaaaaaaaaaaaaaaaaaaaaaaaaaaaaaaaaaaaaaaaaaaacgagactagttctctcttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtatggt

SEQ ID NO: 279361 - DNA, 3290 bp, Homo sapiens
  misc_feature (3277)..(3277): n is a, c, g, or t
cggctagtacgaggccggtgttaatcggccgaggcggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279362 - DNA, 2786 bp, Homo sapiens
  misc_feature (2773)..(2773): n is a, c, g, or t
gctaggagcaggctgggtttgaatcggccgaggcgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccaaccttttcttgataaatttgagggcccgtttgtccttggagaccttcagtaactccatggcgcgccgctcgtacggggcaaagccacacacctcccgaatcatgtcccgcacgaacttggtgtgtttggtcagaccccgcggcgtcggctgtgcctgggcttgctcacgttcttggtcactttgtggcccttgttgaggcccacggccatagggtagcgtagggccatggctgctgctctccagagacggccgtggcgganaggctggcgccgc

SEQ ID NO: 279363 - DNA, 2714 bp, Homo sapiens
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggtgagcgtggtggcgggagaagaccccaaagccattcccatttctacccgagaacaagcaggtcccaccttgtacacctgtgcagtgggcctcaggtggctctgaacggcctctggcggggggtggtgtgctgggagcccagggggtctgggctgagggaggggaaggctgtgacacatgggggtggcagcacaccatgggccttatggatttgggtgccactttgataggcttac

SEQ ID NO: 279364 - DNA, 2359 bp, Homo sapiens
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagatggcaggcctctggatttgggcagcctctggattggcagctctgatttt

SEQ ID NO: 279365 - DNA, 1330 bp, Homo sapiens
  misc_feature (1249)..(1249): n is a, c, g, or t
  misc_feature (1262)..(1262): n is a, c, g, or t
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgaaagcctctcctgngagaagattgacngagcagtgaaggccgggcggggggggggaaaacacagcaccccggtctgtgggcctcctctctccggc

SEQ ID NO: 279366 - DNA, 1050 bp, Homo sapiens
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaatgagtccgtgcgtcacgcaggg

SEQ ID NO: 279367 - DNA, 1555 bp, Homo sapiens
gtcccccgcgcgggcgcgggtggatctctcgggctctgacttgttttcgggtcaccttcaggcttcagccaggcacctgacgcctctttcccctcacggtgccaggccgggccgaactacatttcccaggaggctccgcggccaggtgcaaacagcgccgtgctgactacatttcccagacagccttgcggcggcccgggccttaaagcgtccatttcccagcggccctccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgcgagcccttggcgttcagttcgcggtgtcagcctccgcctccgagcctcagttgtcttctctgtgaggtgggaatgccggtgaatcctgccgctggcgtggatgagaagtgaatgcgtgctcggagctgcgagtgacagcgggcaggaggcgcccagggacacttggtttctccagggctggaaggcttctagaaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcaggagggatctaaaagggaaaggaggccgagcacagtggctcacgcctgtaatcccagcactttgggaggctgaggtgggcggatcatctgaagtcaggagttcgagaccagcctgggcaacatggtgaaaccccatctctactaaaaatacaaaaattaaccgtgcgtggtggtgcacacctgtaatcccagctgctgcttgagaggctgaagcaggagaattgcttgaacccaggaggcagaggttgcagtgagccgaggttgcaccactgcactccagcctgggcgacagggcgagactccatctcaaaaaaataaaatacaaaaattagcctggtatggtggcgcacttgtagtcccagctacttgggaggctgaggcaagagaatcgcttgaacccaggaggcgaaggttgcagtgagccgagattgcactactgcactccagcctgggagacagagcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtgaaaaaaaaaaaaaaaaaa

SEQ ID NO: 279368 - DNA, 800 bp, Homo sapiens
aattttttatttttatgggctttagcgatggaggtaggattggtgctgtgggtgaaagagtatgatggggggcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggaggtttctgggcccaggatggtgttcatcaggcctggtcccctccgttctgcagagcgacagatgccccttgctcccggtgcctgagcagagagatgattcttctaagagagttcagacggcccacgtggagctagccaggagagttaaatgagtggctgcagatagtatttgggagactggcaggtggttctcattgtatttctggttgatgatgcattgtaaatcataaaaatggatcctgccaaggccaggaggcagatgcca

SEQ ID NO: 279369 - DNA, 4033 bp, Homo sapiens
tccgccggctcacgtgaccgtctttgggccggcgcgaaccatggccggcatggtggacttccaggatgaggagcaggtcaagtcctttttggagaacatggaggtggagtgcaactaccactgctaccacgagaaggacccggacggttgctatcggctggtggactatttggaagggatccggaagaattttgatgaggctgccaaggtgttgaagtttaactgtgaagagaaccagcacagtgatagctgctacaaactgggggcctactatgtgactggaaaaggtggtctgacccaggacctgaaagctgccgccaggtgctttttgatggcgtgtgagaagcctggaaagaagtcaatagcagcatgtcacaacgttggcctcctggcacatgatggacaggttaatgaggatggccagcctgacttgggaaaggccagggactactacacaagggcctgtgatggtggctatacttccagttgcttcaacctcagtgccatgttcctgcagggtgccccaggctttcccaaggacatggacctggcatgtaaatactccatgaaagcctgtgacctgggtcatatctgggcctgtgccaatgccagtcgcatgtacaagctgggggatggtgttgataaggatgaggccaaggccgaggtgctaaaaaatcgagcccagcagctacacaaagaacagcagaaaggtgtccaacccttaacatttgggtaatgtggtccaccctccctcccaggcaacaaactgcttgaggctggcagctcctgtttctgaagactgatgcagcccttgaaggtcaacctgctggagcaaaaaaacttgggacttgaatttgtagctccatttacatggatccattgccccagctactggagtatagcctacaatgtttatttcagtcaatattcctttatctgggtgttctgtacaatgtttattacagtcaatattccttcatctggatgttctgtgaagatagccatgtttatgggggtcttagttttcaaactctggcaactctgtgaaaaataggagcaaactagagagccctggagattggtagtagggaagggaggatagcaggaagtttgaaaaattagcagccccggggcctaaaggaatcagctgtcatcattttcatcattattattttggttaggatggcttgaaaatcagaacgtatcttggtttacgtaattgaggtcttaaagaactaagaacagttaaatagtcacaactaccaccctctgacttacataatcattggtgtgggcttcgttttgcctttagagtcacatctttcagtaaattcacagagatcaagagggacgtgcaacatacagcttaaaggctgttatgcttcagggttgctgaagaagatgaaacatcagcctgccatcgtctagaagagacattggcagttaaaaattagcacctccagtgtagtcgcctggcactgcccatcatgctgagggagcagattcttcccaaggcagcttcagctaggagtttgtaagcaaggactttgtgacacatttgtcccctggaactgagcctttttaactgtccctgtgaatgaacaattttgagtgacctacggtttgtgttaattagtgttctttccagattccaggtaccgtagagagtatgttctttgtggtggttgtgccttttaagaacatttgtggccgggcacggtggctcacgcctgtaaccccagcactttgggtggccaaggcgggtggatcacgagatcaggagatcatgaccatcctggctaacacggggaaaccccatctctactaaaaaatacaaaaaattagccgggcgtggtggcaggcgcctgtagtcccagctactggggaggctgaggcaggagaattgcttgaacccgggaggcggagcttgcagtgagctgagattgcgccactgccctccagcctgggcgatagagtgagactccgtctcaaaaaaaaaaaaaaatttgctttttctgttgtctccccagcttgtcaccagggggcgagcttgccatttccctgctggtaacaataccattctgtcaccatctactgttttaggcttccgttttgcagccgtcctgaaaggaaggcttgctgtgtaaatgaaggcttgtgagcacagcagccagcctctcaagttgatagaggacagggacttccccaagtgcacagaggagatttcaaaagacatcaaattcactttttaaaaatgtaaagtagcttttggtgtgcttaaactaggtcaggccaggcgtggtggctcatgcctgtaatcctagcattttgggaggccaaggcaggtggatcacttgaggtcaggagttcgagatcagcctggccaacatgacgaaacccctttctctactaaaaatataaaaattagctgggcgtggtgatgcatacctgtaatcccagctacttcggaggctgaggcaggagaatcacttgaacctgggaggcagaggttgcagtaaactgagactgtgccactgcactccagcctgggcaacacagcaagactctgtctcaaaaacaaaaacaaaactaggccaggtgcagtggctcacgcttgcaatcccagcactttgggaggccgaggcaggcggatcacgaggtcaggatttcgagaacagcctggccaacatagtgaaacctcgtatctactaaaaatacaaaaattatctgggtgtggtggtgggcacctgttgtcccagctattcaggaggctgaggcaggagaatcgcttgaacccaggaggtggaggttgcagtgagccaagaccatgccattgcactccagccaggtaacagagtgagactctgtctcaaaaaaacacacacacacacacacacaaaactgtaggtcaaaaaacatgaaaatatgttcaacatcactaattagggaaatgtaaatcaaaaaccacaatgaactcttaaaattcaacagtaagaaaacaacctgattaaaaacaggccaaaacccttaacatatctcagcaaagaagatagacaggtggcaaataagcatatgaaaagatgttccatataacatgtcatcaggaaaatgcaagttagaacaacagaccactatacaactattagaatggccaaaatccaaagcaccgacagcatgaaatgctgggaaagttggagcaaccagaactcttattccttgctggtgggaacgcaagatggcacagccactttggaagacagttaagcagtttcttacaaaaactaggtaagctcttaccatgtgatccagcaatcttgctctttagtatttacctgaaggaactgaaaacatgtccacacaaaaaccagcacatggatgtttatagcagctttatctataattgccaaaactcaacccaaaatgtctttcagtaggtaaatgggtaaataaattgtggtgcatgtagtcattattcagtgcttaaatcaagctatgacaaattatgagttatcaagctataagaagtcacagaggaacttaaatgaatgctactaaatgaagccagtctgaaaaggcttcatattaaatgatgccaactatatgacactgggatgtattctggaaaaggcaaaactatggagacagtaaaaagcagtgggtgggggaggggagggaggaataattggagcacagaagatttttagggcagcgaaactactctgtatgatactataattataaatacctgtcattgtacatatgtccaaccccctaaaatgtacaacaccaagagtgaaccctaatgtaaactgtggactttgagtgataatgatgtgtcagtgtaggttcatcaattactgcaaatgtacctctttggtgggagatgttgaaaatggtggagactatgcatgtgtggggacaacaactatatgggaaatctctgtaccctctcaattttgctgtaaacctaaaattgctctaaaatataaagtctattaaaaccacaatgatattgcctcatatcccattagga

SEQ ID NO: 279370 - DNA, 3979 bp, Homo sapiens
tccgccggctcacgtgaccgtctttgggccggcgcgaaccatggccggcatggtggacttccaggatgaggagcaggtcaagtcctttttggagaacatggaggtggagtgcaactaccactgctaccacgagaaggacccggacggttgctatcggctggtggactatttggaagggatccggaagaattttgatgaggctgccaaggtgttgaagtttaactgtgaagagaaccagcacagtgatagctgctacaaactgggggcctactatgtgactggaaaaggtggtctgacccaggacctgaaagctgccgccaggtgctttttgatggcgtgtgagaagcctggaaagaagtcaatagcagcatgtcacaacgttggcctcctggcacatgatggacaggttaatgaggatggccagcctgacttgggaaaggccagggactactacacaagggcctgtgatggtggctatacttccagttgcttcaacctcagtgccatgttcctgcagggtgccccaggctttcccaaggacatggacctggcatgtaaatactccatgaaagcctgtgacctgggtcatatctgggcctgtgccaatgccagtcgcatgtacaagctgggggatggtgttgataaggatgaggccaaggccgaggtgctaaaaaatcgagcccagcagctacacaaagaacagcagaaaggtgtccaacccttaacatttgggtaatgtggtccaccctccctcccaggcaacaaactgcttgaggctggcagctcctgtttctgaagactgatgcagcccttgaaggtcaacctgctggagcaaaaaaacttgggacttgaatttgtagctccatttacatggatccattgccccagctactggagtatagcctacaatgtttatttcagtcaatattcctttatctgggtgttctgtacaatgtttattacagtcaatattccttcatctggatgttctgtgaagatagccatgtttatgggggtcttagttttcaaactctggcaactctgtgaaaaataggagcaaactagagagccctggagattggtagtagggaagggaggatagcaggaagtttgaaaaattagcagccccggggcctaaaggaatcagctgtcatcattttcatcattattattttggttaggatggcttgaaaatcagaacgtatcttggtttacgtaattgaggtcttaaagaactaagaacagttaaatagtcacaactaccaccctctgacttacataatcattggtgtgggcttcgttttgcctttagagtcacatctttcagtaaattcacagagatcaagagggacgtgcaacatacagcttaaaggctgttatgcttcagggttgctgaagaagatgaaacatcagcctgccatcgtctagaagagacattggcagttaagattcttcccaaggcagcttcagctaggagtttgtaagcaaggactttgtgacacatttgtcccctggaactgagcctttttaactgtccctgtgaatgaacaattttgagtgacctacggtttgtgttaattagtgttctttccagattccaggtaccgtagagagtatgttctttgtggtggttgtgccttttaagaacatttgtggccgggcacggtggctcacgcctgtaaccccagcactttgggtggccaaggcgggtggatcacgagatcaggagatcatgaccatcctggctaacacggggaaaccccatctctactaaaaaatacaaaaaattagccgggcgtggtggcaggcgcctgtagtcccagctactggggaggctgaggcaggagaattgcttgaacccgggaggcggagcttgcagtgagctgagattgcgccactgccctccagcctgggcgatagagtgagactccgtctcaaaaaaaaaaaaaaatttgctttttctgttgtctccccagcttgtcaccagggggcgagcttgccatttccctgctggtaacaataccattctgtcaccatctactgttttaggcttccgttttgcagccgtcctgaaaggaaggcttgctgtgtaaatgaaggcttgtgagcacagcagccagcctctcaagttgatagaggacagggacttccccaagtgcacagaggagatttcaaaagacatcaaattcactttttaaaaatgtaaagtagcttttggtgtgcttaaactaggtcaggccaggcgtggtggctcatgcctgtaatcctagcattttgggaggccaaggcaggtggatcacttgaggtcaggagttcgagatcagcctggccaacatgacgaaacccctttctctactaaaaatataaaaattagctgggcgtggtgatgcatacctgtaatcccagctacttcggaggctgaggcaggagaatcacttgaacctgggaggcagaggttgcagtaaactgagactgtgccactgcactccagcctgggcaacacagcaagactctgtctcaaaaacaaaaacaaaactaggccaggtgcagtggctcacgcttgcaatcccagcactttgggaggccgaggcaggcggatcacgaggtcaggatttcgagaacagcctggccaacatagtgaaacctcgtatctactaaaaatacaaaaattatctgggtgtggtggtgggcacctgttgtcccagctattcaggaggctgaggcaggagaatcgcttgaacccaggaggtggaggttgcagtgagccaagaccatgccattgcactccagccaggtaacagagtgagactctgtctcaaaaaaacacacacacacacacacacaaaactgtaggtcaaaaaacatgaaaatatgttcaacatcactaattagggaaatgtaaatcaaaaaccacaatgaactcttaaaattcaacagtaagaaaacaacctgattaaaaacaggccaaaacccttaacatatctcagcaaagaagatagacaggtggcaaataagcatatgaaaagatgttccatataacatgtcatcaggaaaatgcaagttagaacaacagaccactatacaactattagaatggccaaaatccaaagcaccgacagcatgaaatgctgggaaagttggagcaaccagaactcttattccttgctggtgggaacgcaagatggcacagccactttggaagacagttaagcagtttcttacaaaaactaggtaagctcttaccatgtgatccagcaatcttgctctttagtatttacctgaaggaactgaaaacatgtccacacaaaaaccagcacatggatgtttatagcagctttatctataattgccaaaactcaacccaaaatgtctttcagtaggtaaatgggtaaataaattgtggtgcatgtagtcattattcagtgcttaaatcaagctatgacaaattatgagttatcaagctataagaagtcacagaggaacttaaatgaatgctactaaatgaagccagtctgaaaaggcttcatattaaatgatgccaactatatgacactgggatgtattctggaaaaggcaaaactatggagacagtaaaaagcagtgggtgggggaggggagggaggaataattggagcacagaagatttttagggcagcgaaactactctgtatgatactataattataaatacctgtcattgtacatatgtccaaccccctaaaatgtacaacaccaagagtgaaccctaatgtaaactgtggactttgagtgataatgatgtgtcagtgtaggttcatcaattactgcaaatgtacctctttggtgggagatgttgaaaatggtggagactatgcatgtgtggggacaacaactatatgggaaatctctgtaccctctcaattttgctgtaaacctaaaattgctctaaaatataaagtctattaaaaccacaatgatattgcctcatatcccattagga

SEQ ID NO: 279371 - DNA, 3979 bp, Homo sapiens
tccgccggctcacgtgaccgtctttgggccggcgcgaaccatggccggcatggtggacttccaggatgaggagcaggtcaagtcctttttggagaacatggaggtggagtgcaactaccactgctaccacgagaaggacccggacggttgctatcggctggtggactatttggaagggatccggaagaattttgatgaggctgccaaggtgttgaagtttaactgtgaagagaaccagcacagtgatagctgctacaaactgggggcctactatgtgactggaaaaggtggtctgacccaggacctgaaagctgccgccaggtgctttttgatggcgtgtgagaagcctggaaagaagtcaatagcagcatgtcacaacgttggcctcctggcacatgatggacaggttaatgaggatggccagcctgacttgggaaaggccagggactactacacaagggcctgtgatggtggctatacttccagttgcttcaacctcagtgccatgttcctgcagggtgccccaggctttcccaaggacatggacctggcatgtaaatactccatgaaagcctgtgacctgggtcatatctgggcctgtgccaatgccagtcgcatgtacaagctgggggatggtgttgataaggatgaggccaaggccgaggtgctaaaaaatcgagcccagcagctacacaaagaacagcagaaaggtgtccaacccttaacatttgggtaatgtggtccaccctccctcccaggcaacaaactgcttgaggctggcagctcctgtttctgaagactgatgcagcccttgaaggtcaacctgctggagcaaaaaaacttgggacttgaatttgtagctccatttacatggatccattgccccagctactggagtatagcctacaatgtttatttcagtcaatattcctttatctgggtgttctgtacaatgtttattacagtcaatattccttcatctggatgttctgtgaagatagccatgtttatgggggtcttagttttcaaactctggcaactctgtgaaaaataggagcaaactagagagccctggagattggtagtagggaagggaggatagcaggaagtttgaaaaattagcagccccggggcctaaaggaatcagctgtcatcattttcatcattattattttggttaggatggcttgattaaatagtcacaactaccaccctctgacttacataatcattggtgtgggcttcgttttgcctttagagtcacatctttcagtaaattcacagagatcaagagggacgtgcaacatacagcttaaaggctgttatgcttcagggttgctgaagaagatgaaacatcagcctgccatcgtctagaagagacattggcagttaaaaattagcacctccagtgtagtcgcctggcactgcccatcatgctgagggagcagattcttcccaaggcagcttcagctaggagtttgtaagcaaggactttgtgacacatttgtcccctggaactgagcctttttaactgtccctgtgaatgaacaattttgagtgacctacggtttgtgttaattagtgttctttccagattccaggtaccgtagagagtatgttctttgtggtggttgtgccttttaagaacatttgtggccgggcacggtggctcacgcctgtaaccccagcactttgggtggccaaggcgggtggatcacgagatcaggagatcatgaccatcctggctaacacggggaaaccccatctctactaaaaaatacaaaaaattagccgggcgtggtggcaggcgcctgtagtcccagctactggggaggctgaggcaggagaattgcttgaacccgggaggcggagcttgcagtgagctgagattgcgccactgccctccagcctgggcgatagagtgagactccgtctcaaaaaaaaaaaaaaatttgctttttctgttgtctccccagcttgtcaccagggggcgagcttgccatttccctgctggtaacaataccattctgtcaccatctactgttttaggcttccgttttgcagccgtcctgaaaggaaggcttgctgtgtaaatgaaggcttgtgagcacagcagccagcctctcaagttgatagaggacagggacttccccaagtgcacagaggagatttcaaaagacatcaaattcactttttaaaaatgtaaagtagcttttggtgtgcttaaactaggtcaggccaggcgtggtggctcatgcctgtaatcctagcattttgggaggccaaggcaggtggatcacttgaggtcaggagttcgagatcagcctggccaacatgacgaaacccctttctctactaaaaatataaaaattagctgggcgtggtgatgcatacctgtaatcccagctacttcggaggctgaggcaggagaatcacttgaacctgggaggcagaggttgcagtaaactgagactgtgccactgcactccagcctgggcaacacagcaagactctgtctcaaaaacaaaaacaaaactaggccaggtgcagtggctcacgcttgcaatcccagcactttgggaggccgaggcaggcggatcacgaggtcaggatttcgagaacagcctggccaacatagtgaaacctcgtatctactaaaaatacaaaaattatctgggtgtggtggtgggcacctgttgtcccagctattcaggaggctgaggcaggagaatcgcttgaacccaggaggtggaggttgcagtgagccaagaccatgccattgcactccagccaggtaacagagtgagactctgtctcaaaaaaacacacacacacacacacacaaaactgtaggtcaaaaaacatgaaaatatgttcaacatcactaattagggaaatgtaaatcaaaaaccacaatgaactcttaaaattcaacagtaagaaaacaacctgattaaaaacaggccaaaacccttaacatatctcagcaaagaagatagacaggtggcaaataagcatatgaaaagatgttccatataacatgtcatcaggaaaatgcaagttagaacaacagaccactatacaactattagaatggccaaaatccaaagcaccgacagcatgaaatgctgggaaagttggagcaaccagaactcttattccttgctggtgggaacgcaagatggcacagccactttggaagacagttaagcagtttcttacaaaaactaggtaagctcttaccatgtgatccagcaatcttgctctttagtatttacctgaaggaactgaaaacatgtccacacaaaaaccagcacatggatgtttatagcagctttatctataattgccaaaactcaacccaaaatgtctttcagtaggtaaatgggtaaataaattgtggtgcatgtagtcattattcagtgcttaaatcaagctatgacaaattatgagttatcaagctataagaagtcacagaggaacttaaatgaatgctactaaatgaagccagtctgaaaaggcttcatattaaatgatgccaactatatgacactgggatgtattctggaaaaggcaaaactatggagacagtaaaaagcagtgggtgggggaggggagggaggaataattggagcacagaagatttttagggcagcgaaactactctgtatgatactataattataaatacctgtcattgtacatatgtccaaccccctaaaatgtacaacaccaagagtgaaccctaatgtaaactgtggactttgagtgataatgatgtgtcagtgtaggttcatcaattactgcaaatgtacctctttggtgggagatgttgaaaatggtggagactatgcatgtgtggggacaacaactatatgggaaatctctgtaccctctcaattttgctgtaaacctaaaattgctctaaaatataaagtctattaaaaccacaatgatattgcctcatatcccattagga

SEQ ID NO: 279372 - DNA, 1713 bp, Homo sapiens
tccgccggctcacgtgaccgtctttgggccggcgcgaaccatggccggcatggtggacttccaggatgaggagcaggtcaagtcctttttggagaacatggaggtggagtgcaactaccactgctaccacgagaaggacccggacggttgctatcggctggtggactatttggaagggatccggaagaattttgatgaggctgccaaggtgttgaagtttaactgtgaagagaaccagcacagtgatagctgctacaaactgggggcctactatgtgactggaaaaggtggtctgacccaggacctgaaagctgccgccaggtgctttttgatggcgtgtgagaagcctggaaagaagtcaatagcagcatgtcacaacgttggcctcctggcacatgatggacaggttaatgaggatggccagcctgacttgggaaaggccagggactactacacaagggcctgtgatggtggctatacttccagttgcttcaacctcagtgccatgttcctgcagggtgccccaggctttcccaaggacatggacctggcatgtaaatactccatgaaagcctgtgacctgggtcatatctgggcctgtgccaatgccagtcgcatgtacaagctgggggatggtgttgataaggatgaggccaaggccgaggtgctaaaaaatcgagcccagcagctacacaaagaacagcagaaaggtgtccaacccttaacatttgggtaatgtggtccaccctccctcccaggcaacaaactgcttgaggctggcagctcctgtttctgaagactgatgcagcccttgaaggtcaacctgctggagcaaaaaaacttgggacttgaatttgtagctccatttacatggatccattgccccagctactggagtatagcctacaatgtttatttcagtcaatattcctttatctgggtgttctgtacaatgtttattacagtcaatattccttcatctggatgttctgtgaagatagccatgtttatgggggtcttagttttcaaactctggcaactctgtgaaaaataggagcaaactagagagccctggagattggtagtagggaagggaggatagcaggaagtttgaaaaattagcagccccggggcctaaaggaatcagctgtcatcattttcatcattattattttggttaggatggcttgaaaatcagaacgtatcttggtttacgtaattgaggtcttaaagaactaagaacagttaaatagtcacaactaccaccctctgacttacataatcattggtgtgggcttcgttttgcctttagagtcacatctttcagtaaattcacagagatcaagagggacgtgcaacatacagcttaaaggctgttatgcttcagggttgctgaagaagatgaaacatcagcctgccatcgtctagaagagacattggcagttaaaaattagcacctccagtgtagtcgcctggcactgcccatcatgctgagggagcagattcttcccaaggcagcttcagctaggagtttgtaatgcaaatgtacctctttggtgggagatgttgaaaatggtggagactatgcatgtgtggggacaacaactatatgggaaatctctgtaccctctcaattttgctgtaaacctaaaattgctctaaaatataaagtctattaaaaccacaatgatattgcctcatatcccattagga

SEQ ID NO: 279373 - DNA, 752 bp, Homo sapiens
gacaggccctgccggggcagcagctgggaggaaggagagcatctcggggcctctgctgagccactggccatcctgcagcgagatgaggatgggcccaacattgacaacatgaccatggaagctgagaggccagaccctgagctcttcgaccccagcagctgtcctggagaatggctgagtgagccagactgcaccctggagagcgtcaggggcccacgggctcaggggctcccaccccgccgctcccaccagcatggtccaccccggggggccaccagcttcctccagcatgtcaccgggcaccactgatggtgattccacccctgcccatcactgggggctgcgctagctgggctggcattccctcccaacctgaactgctcctcagagccatctcctgaacccacaaattattcttacagaaagatagttatccagaaattctcattccccgtctgcggtgcggtgcgtgcctgcacacctctcctaaacacagcagggctttggagtctggcccatgctccttggccagaaggacagcaggaaagggggctgcaccccgctggccctgcgctcgcccttggccctgctgcctctgtctatttcaatatagaactgttcagcagtcctgcttcaagcctgctctcactgcctggggcttggactggccctggggggaatgggggctccaggctggcacccagtgacttgctctgcgatgctgggcccagttgaccactggcttaggcggg

SEQ ID NO: 279374 - DNA, 2112 bp, Homo sapiens
cccgcgaggaaacgcgctcttagaccatggcgacccaggcgaagcgtccacgggtggcggggcccgtggacggcggcgacctggatcctgtggcctgcttcctgagctggtgccggcgggtggggctggagctgagtcccaaggtggcggtcagccggcagggcacggtggccggctacggcatggtggcccgggagagcgtgcaggccggagagctgctgttcgtggtgccgcgggccgcgctcctgtcgcagcacacctgctccatcggcggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggccagaggaggagcgccggtgcctgctccagggcacaggcgtacctgaggccgtggagaaggatttggccaacatccgcagcgagtaccagtccatcgtgctgcccttcatggaagcccaccccgatctcttcagcctcagggttcgctccctagaactctaccaccagctggtggcccttgtgatggcctatagctttcaggaaccactggaggaagaagaggatgaaaaggagcccaactcccccgtgatggtgcctgctgcagacatactaaaccacttagccaatcacaacgccaatctagaatactctgcgaattgtcttcggatggtagccactcagcccattcctaaaggccatgagattttcaacacttatgggcaaatggctaactggcaactgattcatatgtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggaactgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttacttaaagcatgttacagctgttttgttctcagttttaaccaaagccagtggacatacggtagtaataagtaagtcttgttgtgtttcagcatttaataatagactttggaggtagacccctggtttaaatctaagtctagtttgaggaagtcacttaacctttattgaaaagactctggatttaataagctgtgtaactggtactcgatagttacccaaagttcagtctagatggcacaaaccacctctcagggaataaaccctaagacatcactcaaggaggacttcaattatttaattttgaactgttttgtcctctctggccataaaacttgacagtcatgaaaggtaaggcaaattttaagtgggttaagtttttaaatacgtatctactcattttctttaaaaaaaaaaaaaatacctgggggaaaaggatattaaaactgggtattttaaactcagcttaaccagataaacctgctccagcatttgtccagtgttgaaataaataggaagaaaaata

SEQ ID NO: 279375 - DNA, 3403 bp, Homo sapiens
cccgcgaggaaacgcgctcttagaccatggcgacccaggcgaagcgtccacgggtggcggggcccgtggacggcggcgacctggatcctgtggcctgcttcctgagctggtgccggcgggtggggctggagctgagtcccaaggtggcggtcagccggcagggcacggtggccggctacggcatggtggcccgggagagcgtgcaggccggagagctgctgttcgtggtgccgcgggccgcgctcctgtcgcagcacacctgctccatcggcggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggccagaggaggagcgccggtgcctgctccagggcacaggcgtacctgaggccgtggagaaggatttggccaacatccgcagcgagtaccagtccatcgtgctgcccttcatggaagcccaccccgatctcttcagcctcagggttcgctccctagaactctaccaccagctggtggcccttgtgatggcctatagctttcaggaaccactggaggaagaagaggatgaaaaggagcccaactcccccgtgatggtgcctgctgcagacatactaaaccacttagccaatcacaacgccaatctagaatactctgcggtgagtggagtttctcttggtgcactgattgagcatgattcaagccattgtgtcttaggctccattctcttactagtgctacaaaatgagtaggtgaaatcagctcctcctgtatgtccttttagtatgcatattactgtagaatcatttgaatgcgaaacattttaaagtcctcaaagtaagttgtggttaatcctctgataaactatactaccatcatttatttagtgctagacattgagtggtctgcatagccatgtttcattcctttctggctgatcacatcagtgagcccagactgtgtgtggctctgtggatagcagcctggaacagtgatagtctccgtgttttggagggatgaggacattcacaggccaaaggtctaagacgatcctagaactgatataaagctgtgtttataccagctctattctatataaaaagtagcctgaaaagatggcacatttataggatcagaaattagtaagtatggttatttcttaatccttgcctccattttcctttcccactttgatctgcgaaagttccattttttcccccccgaggcggagtctcactgtgtcgcccaggctggagtgcagtggcgtgatctcggctcactgcaactgccgcctcctgggttcaagcaattctccctgcctcagcctcccgagtagttggaattacaggctcctgccaccatgcccggctaatttttgtattttttagtagggatggggtttctccgtgttggccaggctggtcttgaactcctgatctcaggtcatctgcccactttgacctccctaagtgctgggattacaggtgtgagccactgcgcctggccgaaaatttcgtttttaaagctagcaactttttaagtgctgaagaggactgtgcagaaatccacccagttaaacatgaagctggccttttaaagttagcccaacccttttttgtttcacagtttagggtctaacaggaactaaaggtagaactttggtagttaacagcatcagtcatggctgaactacacctgctgaaggctcttcttaagtggaaataatcttcatggggctggcccgtgaaaggcatggccccagcttctccctttcacctcagaattgtcttcggatggtagccactcagcccattcctaaaggccatgagattttcaacacttatgggcaaatggctaactggcaactgattcatatgtacggttttgttgaaccatatcctgacaacacagatgacacagctgacattcagatggtgacagttcgtgaggcagcattacagggtgagtgtatcattaactcaatatttgacactgatggtgtgtctatacccatgcctcaggttaaatagctttgctaaatagcagttgactttgtagactgggtggcagactaaagaagaaatgaacccttgggtgtactgagactttcacattgctgtttcatctacaggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggaactgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttacttaaagcatgttacagctgttttgttctcagttttaaccaaagccagtggacatacggtagtaataagtaagtcttgttgtgtttcagcatttaataatagactttggaggtagacccctggtttaaatctaagtctagtttgaggaagtcacttaacctttattgaaaagactctggatttaataagctgtgtaactggtactcgatagttacccaaagttcagtctagatggcacaaaccacctctcagggaataaaccctaagacatcactcaaggaggacttcaattatttaattttgaactgttttgtcctctctggccataaaacttgacagtcatgaaaggtaaggcaaattttaagtgggttaagtttttaaatacgtatctactcattttctttaaaaaaaaaaaaaatacctgggggaaaaggatattaaaactgggtattttaaactcagcttaaccagataaacctgctccagcatttgtccagtgttgaaataaataggaagaaaaata

SEQ ID NO: 279376 - DNA, 1982 bp, Homo sapiens
cccgcgaggaaacgcgctcttagaccatggcgacccaggcgaagcgtccacgggtggcggggcccgtggacggcggcgacctggatcctgtggcctgcttcctgagctggtgccggcgggtggggctggagctgagtcccaaggtggcggtcagccggcagggcacggtggccggctacggcatggtggcccgggagagcgtgcaggccggagagctgctgttcgtggtgccgcgggccgcgctcctgtcgcagcacacctgctccatcggcggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggccagaggaggagcgccggtgcctgctccagggcacaggcgtacctgaggccgtggagaaggatttggccaacatccgcagcgagtaccagtccatcgtgctgcccttcatggaagcccaccccgatctcttcagcctcagggttcgctccctagaactctaccaccagctggtggcccttgtgatggcctatagctttcaggaaccactggaggaagaagaggatgaaaaggagcccaactcccccgtgatggtgcctgctgcagacatactaaaccacttagccaatcacaacgccaatctagaatactctgcgatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggaactgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttacttaaagcatgttacagctgttttgttctcagttttaaccaaagccagtggacatacggtagtaataagtaagtcttgttgtgtttcagcatttaataatagactttggaggtagacccctggtttaaatctaagtctagtttgaggaagtcacttaacctttattgaaaagactctggatttaataagctgtgtaactggtactcgatagttacccaaagttcagtctagatggcacaaaccacctctcagggaataaaccctaagacatcactcaaggaggacttcaattatttaattttgaactgttttgtcctctctggccataaaacttgacagtcatgaaaggtaaggcaaattttaagtgggttaagtttttaaatacgtatctactcattttctttaaaaaaaaaaaaaatacctgggggaaaaggatattaaaactgggtattttaaactcagcttaaccagataaacctgctccagcatttgtccagtgttgaaataaataggaagaaaaata

SEQ ID NO: 279377 - DNA, 194 bp, Homo sapiens
cgccggggcgctcacacctgtgtcttcctcagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggtgagagccttgggaggggt

SEQ ID NO: 279378 - DNA, 3234 bp, Homo sapiens
cccgcgaggaaacgcgctcttagaccatggcgacccaggcgaagcgtccacgggtggcggggcccgtggacggcggcgacctggatcctgtggcctgcttcctgagctggtgccggcgggtggggctggagctgagtcccaaggtggcggtcagccggcagggcacggtggccggctacggcatggtggcccgggagagcgtgcaggccggagagctgctgttcgtggtgccgcgggccgcgctcctgtcgcagcacacctgctccatcggcggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggccagaggaggagcgccggtgcctgctccagggcacaggcgtacctgaggccgtggagaaggatttggccaacatccgcagcgagtaccagtccatcgtgctgcccttcatggaagcccaccccgatctcttcagcctcagggttcgctccctagaactctaccaccagctggtggcccttgtgatggcctatagctttcaggaaccactggaggaagaagaggatgaaaaggagcccaactcccccgtgatggtgcctgctgcagacatactaaaccacttagccaatcacaacgccaatctagaatactctgcggtgagtggagtttctcttggtgcactgattgagcatgattcaagccattgtgtcttaggctccattctcttactagtgctacaaaatgagtaggtgaaatcagctcctcctgtatgtccttttagtatgcatattactgtagaatcatttgaatgcgaaacattttaaagtcctcaaagtaagttgtggttaatcctctgataaactatactaccatcatttatttagtgctagacattgagtggtctgcatagccatgtttcattcctttctggctgatcacatcagtgagcccagactgtgtgtggctctgtggatagcagcctggaacagtgatagtctccgtgttttggagggatgaggacattcacaggccaaaggtctaagacgatcctagaactgatataaagctgtgtttataccagctctattctatataaaaagtagcctgaaaagatggcacatttataggatcagaaattagtaagtatggttatttcttaatccttgcctccattttcctttcccactttgatctgcgaaagttccattttttcccccccgaggcggagtctcactgtgtcgcccaggctggagtgcagtggcgtgatctcggctcactgcaactgccgcctcctgggttcaagcaattctccctgcctcagcctcccgagtagttggaattacaggctcctgccaccatgcccggctaatttttgtattttttagtagggatggggtttctccgtgttggccaggctggtcttgaactcctgatctcaggtcatctgcccactttgacctccctaagtgctgggattacaggtgtgagccactgcgcctggccgaaaatttcgtttttaaagctagcaactttttaagtgctgaagaggactgtgcagaaatccacccagttaaacatgaagctggccttttaaagttagcccaacccttttttgtttcacagtttagggtctaacaggaactaaaggtagaactttggtagttaacagcatcagtcatggctgaactacacctgctgaaggctcttcttaagtggaaataatcttcatggggctggcccgtgaaaggcatggccccagcttctccctttcacctcagaattgtcttcggatggtagccactcagcccattcctaaaggccatgagattttcaacacttatgggcaaatggctaactggcaactgattcatatgtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggaactgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttacttaaagcatgttacagctgttttgttctcagttttaaccaaagccagtggacatacggtagtaataagtaagtcttgttgtgtttcagcatttaataatagactttggaggtagacccctggtttaaatctaagtctagtttgaggaagtcacttaacctttattgaaaagactctggatttaataagctgtgtaactggtactcgatagttacccaaagttcagtctagatggcacaaaccacctctcagggaataaaccctaagacatcactcaaggaggacttcaattatttaattttgaactgttttgtcctctctggccataaaacttgacagtcatgaaaggtaaggcaaattttaagtgggttaagtttttaaatacgtatctactcattttctttaaaaaaaaaaaaaatacctgggggaaaaggatattaaaactgggtattttaaactcagcttaaccagataaacctgctccagcatttgtccagtgttgaaataaataggaagaaaaata

SEQ ID NO: 279379 - DNA, 3306 bp, Homo sapiens
cccgcgaggaaacgcgctcttagaccatggcgacccaggcgaagcgtccacgggtggcggggcccgtggacggcggcgacctggatcctgtggcctgcttcctgagctggtgccggcgggtggggctggagctgagtcccaaggtgagcgagcgagccggcgggcggaggacccgcggcggggcgcgggctgccctgaccagccctcctgctcaggtggcggtcagccggcagggcacggtggccggctacggcatggtggcccgggagagcgtgcaggccggagagctgctgttcgtggtgccgcgggccgcgctcctgtcgcagcacacctgctccatcggcggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggccagaggaggagcgccggtgcctgctccagggcacaggcgtacctgaggccgtggagaaggatttggccaacatccgcagcgagtaccagtccatcgtgctgcccttcatggaagcccaccccgatctcttcagcctcagggttcgctccctagaactctaccaccagctggtggcccttgtgatggcctatagctttcaggaaccactggaggaagaagaggatgaaaaggagcccaactcccccgtgatggtgcctgctgcagacatactaaaccacttagccaatcacaacgccaatctagaatactctgcggtgagtggagtttctcttggtgcactgattgagcatgattcaagccattgtgtcttaggctccattctcttactagtgctacaaaatgagtaggtgaaatcagctcctcctgtatgtccttttagtatgcatattactgtagaatcatttgaatgcgaaacattttaaagtcctcaaagtaagttgtggttaatcctctgataaactatactaccatcatttatttagtgctagacattgagtggtctgcatagccatgtttcattcctttctggctgatcacatcagtgagcccagactgtgtgtggctctgtggatagcagcctggaacagtgatagtctccgtgttttggagggatgaggacattcacaggccaaaggtctaagacgatcctagaactgatataaagctgtgtttataccagctctattctatataaaaagtagcctgaaaagatggcacatttataggatcagaaattagtaagtatggttatttcttaatccttgcctccattttcctttcccactttgatctgcgaaagttccattttttcccccccgaggcggagtctcactgtgtcgcccaggctggagtgcagtggcgtgatctcggctcactgcaactgccgcctcctgggttcaagcaattctccctgcctcagcctcccgagtagttggaattacaggctcctgccaccatgcccggctaatttttgtattttttagtagggatggggtttctccgtgttggccaggctggtcttgaactcctgatctcaggtcatctgcccactttgacctccctaagtgctgggattacaggtgtgagccactgcgcctggccgaaaatttcgtttttaaagctagcaactttttaagtgctgaagaggactgtgcagaaatccacccagttaaacatgaagctggccttttaaagttagcccaacccttttttgtttcacagtttagggtctaacaggaactaaaggtagaactttggtagttaacagcatcagtcatggctgaactacacctgctgaaggctcttcttaagtggaaataatcttcatggggctggcccgtgaaaggcatggccccagcttctccctttcacctcagaattgtcttcggatggtagccactcagcccattcctaaaggccatgagattttcaacacttatgggcaaatggctaactggcaactgattcatatgtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggaactgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttacttaaagcatgttacagctgttttgttctcagttttaaccaaagccagtggacatacggtagtaataagtaagtcttgttgtgtttcagcatttaataatagactttggaggtagacccctggtttaaatctaagtctagtttgaggaagtcacttaacctttattgaaaagactctggatttaataagctgtgtaactggtactcgatagttacccaaagttcagtctagatggcacaaaccacctctcagggaataaaccctaagacatcactcaaggaggacttcaattatttaattttgaactgttttgtcctctctggccataaaacttgacagtcatgaaaggtaaggcaaattttaagtgggttaagtttttaaatacgtatctactcattttctttaaaaaaaaaaaaaatacctgggggaaaaggatattaaaactgggtattttaaactcagcttaaccagataaacctgctccagcatttgtccagtgttgaaataaataggaagaaaaata

SEQ ID NO: 279380 - DNA, 3308 bp, Homo sapiens
taggctagtacgaggctcgtttgaatcggcaacgaggccaggcgaagcgtcacgggtggcggggcccgtggacggcggcgacctggatcctgtggcctgcttcctgagctggtgccggcgggtggggctggagctgagtcccaaggtgagcgagcgagccggcgggcggaggacccgcggcggggcgcgggctgccctgaccagccctcctgctcaggtggcggtcagccggcagggcacggtggccggctacggcatggtggcccgggagagcgtgcaggccggagagctgctgttcgtggtgccgcgggccgcgctcctgtcgcagcacacctgctccatcggcggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggccagaggaggagcgccggtgcctgctccagggcacaggcgtacctgaggccgtggagaaggatttggccaacatccgcagcgagtaccagtccatcgtgctgcccttcatggaagcccaccccgatctcttcagcctcagggttcgctccctagaactctaccaccagctggtggcccttgtgatggcctatagctttcaggaaccactggaggaagaagaggatgaaaaggagcccaactcccccgtgatggtgcctgctgcagacatactaaaccacttagccaatcacaacgccaatctagaatactctgcggtgagtggagtttctcttggtgcactgattgagcatgattcaagccattgtgtcttaggctccattctcttactagtgctacaaaatgagtaggtgaaatcagctcctcctgtatgtccttttagtatgcatattactgtagaatcatttgaatgcgaaacattttaaagtcctcaaagtaagttgtggttaatcctctgataaactatactaccatcatttatttagtgctagacattgagtggtctgcatagccatgtttcattcctttctggctgatcacatcagtgagcccagactgtgtgtggctctgtggatagcagcctggaacagtgatagtctccgtgttttggagggatgaggacattcacaggccaaaggtctaagacgatcctagaactgatataaagctgtgtttataccagctctattctatataaaaagtagcctgaaaagatggcacatttataggatcagaaattagtaagtatggttatttcttaatccttgcctccattttcctttcccactttgatctgcgaaagttccattttttcccccccgaggcggagtctcactgtgtcgcccaggctggagtgcagtggcgtgatctcggctcactgcaactgccgcctcctgggttcaagcaattctccctgcctcagcctcccgagtagttggaattacaggctcctgccaccatgcccggctaatttttgtattttttagtagggatggggtttctccgtgttggccaggctggtcttgaactcctgatctcaggtcatctgcccactttgacctccctaagtgctgggattacaggtgtgagccactgcgcctggccgaaaatttcgtttttaaagctagcaactttttaagtgctgaagaggactgtgcagaaatccacccagttaaacatgaagctggccttttaaagttagcccaacccttttttgtttcacagtttagggtctaacaggaactaaaggtagaactttggtagttaacagcatcagtcatggctgaactacacctgctgaaggctcttcttaagtggaaataatcttcatggggctggcccgtgaaaggcatggccccagcttctccctttcacctcagaattgtcttcggatggtagccactcagcccattcctaaaggccatgagattttcaacacttatgggcaaatggctaactggcaactgattcatatgtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggaactgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttacttaaagcatgttacagctgttttgttctcagttttaaccaaagccagtggacatacggtagtaataagtaagtcttgttgtgtttcagcatttaataatagactttggaggtagacccctggtttaaatctaagtctagtttgaggaagtcacttaacctttattgaaaagactctggatttaataagctgtgtaactggtactcgatagttacccaaagttcagtctagatggcacaaaccacctctcagggaataaaccctaagacatcactcaaggaggacttcaattatttaattttgaactgttttgtcctctctggccataaaacttgacagtcatgaaaggtaaggcaaattttaagtgggttaagtttttaaatacgtatctactcattttctttaaaaaaaaaaaaaatacctgggggaaaaggatattaaaactgggtattttaaactcagcttaaccagataaacctgctccagcatttgtccagtgttgaaataaataggaagaaaaata

SEQ ID NO: 279381 - DNA, 564 bp, Homo sapiens
aggacactatcacaagatccaaatcaatgtccttccgggagaatttcttaaaatcttgttttctctcgttgtcttcggaagaagcccgacatttcttataggaaatggaactcttcataagtctggccatggaggcatggtatccgtaacatcccccaaaggagctaaagaagaaatccacaatttaccatgagcatttctcgtctgaagattgccaagcgattcctccaggacattcctcaagatcaatttctgttcatccaccttgtcctgggagggacatcaatgggtttccatgtcctttggcttctggttgagttcactcagtggagaaccctggcaagaggcaggaaaaggggaggaaggtgaaaaccatccatttcttggagaagtgccacggtggggttgcaagtcccaggatcaagatttcgatgtgtctctttttcccgtaaagtggctgaaatctgaagctgaatctgcaagtgtcatggagtcattgaatctcacagtctcaactgataaaagttattaaaggtcgtctggttcagccttctaaaaaaaaag

SEQ ID NO: 279382 - DNA, 541 bp, Homo sapiens
gtttaccacctgtaggttccagagagctcggatggtggtggtgattgtgctaagtttcaaattcagtatttaggtttggtttttagcttataggcaacaaattggctgactatggggtgaaaaggaagcacctcctttatcaagattggcttcaaaagatgtctgcctccccttctggtgggtcctgtgtccattcacagtgtgagaaatggaaaggaggtcactaagagacttgcaatggatgtaataactggatgcagaaactctggatctgaagggaatgttcatgactatttcatccctcctgctgccttggagaaccaaacgcaggagccacccaaggtgaaaaccatccatttcttggagaagtgccacggtggggttgcaagtcccaggatcaagatttcgatgtgtctctttttcccgtaaagtggctgaaatctgaagctgaatctgcaagtgtcatggagtcattgaatctcacagtctcaactgataaaagttattaaaggtcgtctggttcagccttctaaaaaaaaag

SEQ ID NO: 279383 - DNA, 886 bp, Homo sapiens
aggacactatcacaagatccaaatcaatgtccttccgggagaatttcttaaaatcttgttttctctcgttgtcttcggaagaagcccgacatttcttataggaaatggaactcttcataagtctggccatggaggcatggtatccgtaacatcccccaaaggagctaaagaagaaatccacaatttaccatgagcatttctcgtctgaagattgccaagcgattcctccaggacattcctcaagatcaatttctgttcatccaccttgtcctgggagggacatcaatgggtttccatgtcctttggcttctggttgagttcactcagtggagaaccctggcaagaggcaggaaaaggggaggaagcagcctgaccggtttgaatttcaccttctgttcaccttggatgagagcagtaatcatcacgatcccagggaacagccaaaggaagagaaaaggcaaaagatttggacaagactcatgaagactaacagctcttggataattgagagaaggcagctgcgtgaacagttttgatgcaatcatgaaggcagggcccagtgcctgtggcatctgcctttttctggaaccaatccatatttccttgtggttttctaaggtgcagagagggcacattgggaactttgcttggggtctttttcacatcttagagggaaggtccctcaacatctgcattggcggagtgtgatcctcatgtccctctgaatgatctggacttgaggtaaccagccccttccaggaagctgtcccatgagtgaagcctcagcagcagcctctgtcagtccctcccccacagaacctttggcttccatttgaccagccttgacatccagtgtccaaacaccgataaaattgattccactaag

SEQ ID NO: 279384 - DNA, 980 bp, Homo sapiens
catattcatatgctcttgttccttctcaaataattccatcactaatacacattccttgctgctgcttcctgctttcgcttttgaagtgcccttccatccactcctcagctctattccctgcatatctctaggaggctgtgaggggaaggaattattctctttgttttccacctaaagaaacagaagctctggcaatagtcggctgcttgctcaaggtgacacagttaatggagaggcagatctctggatgcggcgtctcaggggccacgcctgcctcccccgccccgcgcgcatacacagaattcctcatgctgctgctatcacggaactcagggttcatctcaaagatctctctttgcataatgtgtgtgtggacctgcctacagatacattgggtggaagccctaggagcctcaagcaagtctgaagattggccctgagaaccactgttctcattatcagcaaggattttatccagagacctctaggaatacattcactaaaatgtgactgtggtcctgtggttgtatgaactctggctcttctcgtgaattacatttcactggagtcaggtgttttctgtaaacatcgttaaaccacgagaccaactgcattgaacattttttgcactacattgttttatttcttgctcgtcttttccttgcagagctggggctggggtgaggtgtgtggtgtacctagcactcaaaatgtaaggattctcagagtcatacaggtgcacggtcagcacctgagagtgagccaccctttaacattttgccttctaggtgcttcacttgccttgcccaagcactagccctagattaaataatatgtttctattagttttttaaaattataatattaacaataactagcacttattgagcactcccttatgtgccagcaaatgtgacttacatgtatctgcttatttttccttacatgaaaccctctgaagtagatacaatgggtatcat

SEQ ID NO: 279385 - DNA, 390 bp, Homo sapiens
aggacactatcacaagatccaaatcaatgtccttccgggagaatttcttaaaatcttgttttctctcgttgtcttcggaagaagcccgacatttcttataggaaatggaactcttcataaggtcgccccgacccctcctccctgacctgggaagacgcgcgcagtccccgaccagaggacctcagacacaggtgaaaaccatccatttcttggagaagtgccacggtggggttgcaagtcccaggatcaagatttcgatgtgtctctttttcccgtaaagtggctgaaatctgaagctgaatctgcaagtgtcatggagtcattgaatctcacagtctcaactgataaaagttattaaaggtcgtctggttcagccttctaaaaaaaaag

SEQ ID NO: 279386 - DNA, 257 bp, Homo sapiens
gtgacctatcctaccttcgctttaaacccacacctatattaaccacacaaaactctaagtgaaaaccatccatttcttggagaagtgccacggtggggttgcaagtcccaggatcaagatttcgatgtgtctctttttcccgtaaagtggctgaaatctgaagctgaatctgcaagtgtcatggagtcattgaatctcacagtctcaactgataaaagttattaaaggtcgtctggttcagccttctaaaaaaaaag

SEQ ID NO: 279387 - DNA, 577 bp, Homo sapiens
agaaagactttttcctttttgagcacctctttggaccatttacattcattgacagctcagaagaatccaacagttcctggagtttggcaacatttcatggtggagagaaaagcatcccaaggatctgtacataaatagctggtgcacatcggtctcaggtgtaaacagaaggaagtccaaggaagccaagtgggaagatccttgctggtttctccctctgaggaagaaggaaaatgccatgactcccactatggcctctcttggaaccatattttgaggtaccctacttccttcttgagtgtcagcagagcaactgtgggactggcatgagatttggtcatttctaggagagcgaatgccttttgcctctttgatgagaaaactagacgagacattgtttagaaattcttgagctcagactttggcattatgacaacgtgcattcaaatctgccccagccacttgcgagctgggacctaaagccgtgagcttctggttgtttatctataacaagcggatcccagtacctacctcatagggctgctgcgaggattaaaataaaatgcatctatcagcc

SEQ ID NO: 279388 - DNA, 397 bp, Homo sapiens
catattcatatgctcttgttccttctcaaataattccatcactaatacacattccttgctgctgcttcctgctttcgcttttgaagtgcccttccatccactcctcagctctattccctgcatatctctaggaggctgtgaggggaaggaattattctctttgttttccacctaaagaaacagaagctctggcaatagtcggctgcttgctcaaggtgacacagttaatggagaggcagatctctggatgcggcgtctcaggggccacgcctgcctcccccgccccgcgcgcatacacagaattcctcatgctgctgctatcacggaactcaggggtttggctgactttgtctactaggagcagagaacaaagtgtgacttgaaccatgcacatcaa

SEQ ID NO: 279389 - DNA, 767 bp, Homo sapiens
aggacactatcacaagatccaaatcaatgtccttccgggagaatttcttaaaatcttgttttctctcgttgtcttcggaagaagcccgacatttcttataggaaatggaactcttcataaggttcatctcaaagatctctctttgcataatgtgtgtgtggacctgcctacagatacattgggtggaagccctaggagcctcaagcaagtctgaagattggccctgagaaccactgttctcattatcagcaaggattttatccagagacctctaggaatacattcactaaaatgtgactgtggtcctgtggttgtatgaactctggctcttctcgtgaattacatttcactggagtcaggtgttttctgtaaacatcgttaaaccacgagaccaactgcattgaacattttttgcactacattgttttatttcttgctcgtcttttccttgcagagctggggctggggtgaggtgtgtggtgtacctagcactcaaaatgtaaggattctcagagtcatacaggtgcacggtcagcacctgagagtgagccaccctttaacattttgccttctaggtgcttcacttgccttgcccaagcactagccctagattaaataatatgtttctattagttttttaaaattataatattaacaataactagcacttattgagcactcccttatgtgccagcaaatgtgacttacatgtatctgcttatttttccttacatgaaaccctctgaagtagatacaatgggtatcat

SEQ ID NO: 279390 - DNA, 625 bp, Homo sapiens
ctgattttggtagcatcctttggtctcttctagtctgggagtcagagaaagtttgcatcaaaatgtcatcagggattcatttccatcatttcaagcagggtcatcttggaacaggacacaggatagccaaaaacaatccattgatacacttggtgacattaattgagaaaaaaacaatatggtctggccatggaggcatggtatccgtaacatcccccaaaggagctaaagaagaaatccacaatttaccatgagcatttctcgtctgaagattgccaagcgattcctccaggacattcctcaagatcaatttctgttcatccaccttgtcctgggagggacatcaatgggtttccatgtcctttggcttctggttgagttcactcagtggagaaccctggcaagaggcaggaaaaggggaggaaggtgaaaaccatccatttcttggagaagtgccacggtggggttgcaagtcccaggatcaagatttcgatgtgtctctttttcccgtaaagtggctgaaatctgaagctgaatctgcaagtgtcatggagtcattgaatctcacagtctcaactgataaaagttattaaaggtcgtctggttcagccttctaaaaaaaaag

SEQ ID NO: 279391 - DNA, 924 bp, Homo sapiens
agaaagactttttcctttttgagcacctctttggaccatttacattcattgacagctcagaagaatccaacagttcctggagtttggcaacatttcatggtggagagaaaagcatcccaaggatctgtacataaatagctggtgcacatcggtctcaggtgtaaacagaaggaagtccaaggaagccaagtgggaagatccttgctggtttctccctctgaggaagaaggaaaatgccatgactcccactatggcctctcttggaaccatattttgaggttcatctcaaagatctctctttgcataatgtgtgtgtggacctgcctacagatacattgggtggaagccctaggagcctcaagcaagtctgaagattggccctgagaaccactgttctcattatcagcaaggattttatccagagacctctaggaatacattcactaaaatgtgactgtggtcctgtggttgtatgaactctggctcttctcgtgaattacatttcactggagtcaggtgttttctgtaaacatcgttaaaccacgagaccaactgcattgaacattttttgcactacattgttttatttcttgctcgtcttttccttgcagagctggggctggggtgaggtgtgtggtgtacctagcactcaaaatgtaaggattctcagagtcatacaggtgcacggtcagcacctgagagtgagccaccctttaacattttgccttctaggtgcttcacttgccttgcccaagcactagccctagattaaataatatgtttctattagttttttaaaattataatattaacaataactagcacttattgagcactcccttatgtgccagcaaatgtgacttacatgtatctgcttatttttccttacatgaaaccctctgaagtagatacaatgggtatcat

SEQ ID NO: 279392 - DNA, 285 bp, Homo sapiens
taagtcttaggccgtctaggttataatcactgctagatgatccttctcttttttcccattgttaaaaaccttcatacttactttatttcccacaggtgaaaaccatccatttcttggagaagtgccacggtggggttgcaagtcccaggatcaagatttcgatgtgtctctttttcccgtaaagtggctgaaatctgaagctgaatctgcaagtgtcatggagtcattgaatctcacagtctcaactgataaaagttattaaaggtcgtctggttcagccttcta

SEQ ID NO: 279393 - DNA, 479 bp, Homo sapiens
acatgggcgcccacccagcgtcgggccgcgtttaagccacctgcccacccccggggctctcgctgaccttcaaagttgagattggccccatgccgcaagagaacgtcggccgcccgcgtcagccccagctcagccatcttgagcagggcgttgctgacgccttcctggtaaaagggagagtgggctttcctctccagcagctcagtgagaacaaggattcggctctcctcgctggcgacataactgggcctgggacaggagagaggctgaggaaagcccttccatcctcaaacccgcaggaccccagccccggcaacacctgcagccaggacagcaacacagcctcctccctcccctcacattgagaccttcagctgatattgatgaagaaagcctacgtttccaccagagtccctggatggcgagactcatcattaccacgtgttggaaataccaactgacaaccccctcaacacctg

SEQ ID NO: 279394 - DNA, 452 bp, Homo sapiens
acatgggcgcccacccagcgtcgggccgcgtttaagccacctgcccacccccggggctctcgctgaccttcaaagttgagattggccccatgccgcaagagaacgtcggccgcccgcgtcagccccagctcagccatcttgagcagggcgttgctgacgccttcctggtaaaagggagagtgggctttcctctccagcagctcagtgagaacaaggattcggctctcctcgctggcgacataactgggcctgggacaggagagaggctgagggaccccagccccggcaacacctgcagccaggacagcaacacagcctcctccctcccctcacattgagaccttcagctgatattgatgaagaaagcctacgtttccaccagagtccctggatggcgagactcatcattaccacgtgttggaaataccaactgacaaccccctcaacacctg

SEQ ID NO: 279395 - DNA, 1811 bp, Homo sapiens
agcaaagagccgaggccgggcgcgcgaccctcgtccttctgcccctggccgcacactttgcgcacatctctttttctgcatggtggatattatttttcattatccttttctgggtgctatgggtgatcattccaagaagaagcccgggacggccatgtgcgtgggctgcgggagtcagatccacgaccagtttatcctgcgggtgtcgcccgacctcgagtggcacgcggcctgcctcaagtgtgccgagtgcagccagtacctggacgagacgtgcacgtgcttcgtgagagacgggaagacctactgcaagcgggactacgtcaggctgttcggcatcaagtgcgccaagtgccaggtgggcttcagcagcagcgacctggtgatgagggcgcgggacagcgtgtaccacatcgagtgcttccgctgctccgtgtgcagccgccagctgctgcctggggacgagttctcgctgcgggagcacgagctgctctgccgcgccgaccacggcctcctgctcgagcgcgccgcggccggcagcccgcgcagccccggcccgcttcccggcgcccgcggcctgcatctgcccgacgctgggtcgggccggcagcccgcgttgcgcccgcacgtgcacaagcagacggagaagacgacccgcgtgcggactgtgctgaacgagaagcagctgcacactctgcggacctgctacgccgccaacccgcggcccgacgctctcatgaaggagcagctggtggagatgaccggcctgagcccgcgggtcatccgcgtctggttccagaacaagcgctgcaaggacaagaagaaatccattctcatgaagcagctgcagcagcagcagcacagcgacaagacgagccttcagggactgactgggacgcccctggtggcgggcagtcccatccgccatgagaacgccgtgcagggcagcgcagtggaggtgcagacgtaccagccgccgtggaaggcgctcagcgagtttgccctccagagcgacctggaccaacccgccttccaacagctggtctccttctccgagtccggctccctaggcaactcctccggcagcgacgtgacctccctgtcctcgcagctcccggacacccccaacagtatggtgccgagtcccgtggagacgtgagggggacccctccctgccagcccgcggacctcgcatgctccctgcatgagactcacccatgctcaggccattccagttccgaaagctctctcgccttcgtaattattctattgttatttatgagagagtaccgagagacacggtctggacagcccaaggcgccaggatgcaacctgctttcaccagactgcagacccctgctccgaggactcttagtttttcaaaaccagaatctgggacttaccagggttagctctgccctctcctctcctctctacgtggccgccgctctgtctctccacgccccacctgtgtccccatctcggccggcccggagctcgcccacgcggacccccgccctgccccagctcagcgctccctggcggcttcgcccgggctcctagcggggaaaaggaaggggataactcagaggaacagacactcaaactcccaaagcgcatgattgctgggaaacagtagaaaccagacttgccttgaaagtgtttaagttattcgacggaggacagagtatgtgagcctttgccgaacaaacaaacgtaagttattgttatttattgtgagaacagccagttcatagtgggacttgtattttgatcttaataaaaaataataacccggggaaaaaaaaatc

SEQ ID NO: 279396 - DNA, 648 bp, Homo sapiens
gcggccgcaggcccagcgctgacaccgccgcaccttgggcccgcaggctgttcggcatcaagtgcgccaagtgccaggtgggcttcagcagcagcgacctggtgatgagggcgcgggacagcgtgtaccacatcgagtgcttccgctgctccgtgtgcagccgccagctgctgcctggggacgagttctcgctgcgggagcacgagctgctctgccgcgccgaccacggcctcctgctcgagcgcgccgcggccggcagcccgcgcagccccggcccgcttcccggcgcccgcggcctgcatctgcccggtaagcgcgccggggcctgtgccggggtgagcggggtgtatgtgcgtgcgtgtgtgtaggggtacgcttgtgtccctaacgagaagttgtcagttgtgtgtggttccgtctgccgggatagtgtttttctgtatcagtgcggaactgtgtgctgggaacaaggctgtgtgtgttctcgtgtgctcgggagaaactgcgtgtgtatgagtgtgtgagcacggagaattgtgcagaatcgtgttctccatgaccaggaacatgcagggcacagtgctaggagcagaagagtggatgacaacagggaatcttaagtggtgtccgtcttggggcttgtattag

SEQ ID NO: 279397 - DNA, 427 bp, Homo sapiens
cagtaaaggtcgtatctcctcttagtttatatttcccaggaatttccactgcaacagcagagttggtcatgggctcacagagctagagtgagagtcaggaaaactcaacagtggtagctactgtggtctgtccttgaagattctgagcagtgcaaatgtaatatcctgcatcaatcgtctcgaagtcttccactgtaatgacactctgggagattctcgtggtgtgtcccagtcctctgtggatcaacctccaagtgtcttggatcgtcacaggcctttcatcctgtttaacgacacccacaaagactgaagcaagagggacaagctgctataaagagctcccactcacccaacactgttgagcgttcctttcagagagcaaagcacatgcttataaaagactgtttagtatgcgtagctcataagc

SEQ ID NO: 279398 - DNA, 428 bp, Homo sapiens
cagtaaaggtcgtatctcctcttagtttatatttcccaggaatttccactgcaacagcagagttggtcatgggctcacagagctagagtgagagtcaggaaaactcaacagtggtagctactgtggtctgtccttgaagattctgagcagtgcaaatgtaatatcctgcatcaatcgtctcgaagtcttccactgtaatgacactctgggagattctcgtggtgtgtcccagtcctctgtggatcaacctccaagtgtcttggatcgtcacaggcctttcatccttctgccctgggaagatccaggtgaactccacctccacatcgggctcccccaggacagtgcagagcacactgatgtcgtccccacttttcactttgtttgaagaagccaagatggttgttgagggagggccactgggaactgga

SEQ ID NO: 279399 - DNA, 885 bp, Homo sapiens
ttagcagaagtgcagctgggggccattttgtcaagaagtgcttatttggaaaaacaaaacaaaacaaaaaatgaaaaaaaaaaaaaaatctatacaggtgcatgccagtcccccggtaatgaaatgtaacaaaggaagcacttaagttcagtgagggaaatacagctttaaattacagattgtacccagagcactttataaacggtaatgtgtgataatgtattatccttacttctgtgaaattgtggactgcaacttctgccggggccacttaaagggccaggagatggagagggttgcgtgaatgccattcaagaaaagggcaacagaggctaaggggttaaactccccagaaaaccaatttatgcaaagggctggatcctgaccggcattctgcactaaagatctgaattacaaatttagagaatttgctgctcgacaacgaatgcaggaaggacctcactggctgctgggaacaactgcccttttgaatgaattcttttatggttaccagtcaaaaagtcaccgtcagctggaactggaagggaggggcatttcttatctgggcaaaaagcccctgtacccagcgaggtgaaacttgcaaatgatactgtcaccttcctcaatggactgcagctcaggagctcaccaaaggttgcagcagacaacccccacggtgtttggagacaaaggaatagcagctgcctggtttccttgaatcaccccgtgctctgacgatggcagtgatgggcctcccaccaatggcttccccaagtgctgttttcctgcttcatgccaagttaagcattctgatactaagcggcacgagatagttctcaactgggtgaggcacaggtgtgagtaatctcgaggtatggtcaggag

SEQ ID NO: 279400 - DNA, 494 bp, Homo sapiens
gttcagtgagggaaatacagctttaaattacagattgtacccagagcactttataaacggtaatgtgtgataatgtattatccttacttctgtgaaattgtggactgcaacttctgccggggccacttaaagggccaggagatggagagggttgcgtgaatgccattcaagaaaagggcaacagaggctaaggggttaaactccccagaaaaccaatttatgcaaagggctggatcctgaccggcattctgcactaaagatctgaattacaaatttagagaatttgctgctcggtaagtaatttcttttcttcctaatggagactataatttccagtgggccggtgccacttaatttgcactgatagagtgaacaaaatcttgaccacggagaagcctaattctactcaccgtgcaaaattgccctttaaaaaggcttaaagagggacattcaaaggatggttaaaaccaacccctataatcttacattgctgc

SEQ ID NO: 279401 - DNA, 1287 bp, Homo sapiens
cttctatcttcttcacggccgactcagtggtcagcggaaacttgatgatagcatagtggccaagcttgtttctcctgggggtgctcttctgaggctatctgggctgcctccggagtcacagtgtcttgggccgcctgaagatattatttccccctgatgctttcctgaaagctcctgcaatcaactacaggtcagaatgttcgtctccaagacaggactccctctgagactcacagaaaagactatgacaggtactctggttataggcttctgatgatattgcttaaataactttaagaccatacacttgactcagttaaggtctccagaagtccggttgggaacctgatgggttcatgacactgctaactcaagatccacaagactggaattgattacatggcactgaatgaactgatgaaaattgattataattgtatagctttttggagcattgctggttaatattctagtttctggatttaagaaatctctttctcttactctaactgtaacttacaacaatttagtagattatacttttgtaaacagaaattaagcgtttatctttttttcttgcctgatttttccagaattttgaaatccttactgaatactcttatttccacgatgatatagttgttagcaaaagtccaataagaatctattcaccttataacaggacataattggaaattttggttatattatcaaggtttttactggaatatcatatttaggaagtgtacctaagatcagttatgaccagcaattttaaggaagtaaggttgacttttatggagacaatgcttacaaagcactgtgggaaactttgaggaaagttcttcctcaaagattataaagtcacaactacccactatttttatatgtgtgtgtgtgtgtgtgtgtgtgtgtgtgtgtgtgtgttccaaatcacttgtcctagcttgctccagcatgcctggacagaactagacaagccccagcccatagtgcatgccattccttatttggagatgcttccttaactatccctgggcaacttccttttctttctttcttctattccccttacctaattaagaaagttttaaactaacagccaatcgggtaaagtgtaaaatgggaggtcctattccagccaatggaaactggacacagcagtagggtaaacacgtcaggttataagtaactctgtctcctttgtttggtgtgctcttgtagctggacagctattgagtagcaccctttgtgcagaaaaataaagctcgccttgctaagagatca

SEQ ID NO: 279402 - DNA, 796 bp, Homo sapiens
tgccaccgctgctgccactatcgctgtcactgtcgctgctgcctctgtccagctgaaatgaccgtggggaggcctgagggagcccccggaggcgcggaggggagccgtcagatatttccccccgagtccttcgcagacacagaggcaggagaggagctgtccggggatgggctggttttgcccagggccagcaaacttgacgagttcctcagcccagaggaggagatagattctacttctgactcaactgggagcatttaccagaacttacaggaactgaagcagaaagggagatggtgtctgttggagtctctctttcagtctgacccagagagtgatgaaaacctctctgaagatgaggaggacctggagagtttcttccaagacaaggacagggggatggtgcaggtccagtgcccgcaggctctgaggtgtggctccacaaggcgctgcagctccctgaacaaccttccctccaacattcccaggcctcagacccagccaccctcaggctcccggcctccctcccagcacagaagcgtcagctcctgggcatcatccattactgtccctcggccattccgcatgacgctgcgcgaggcccggaagaaggccgagtggctgggctcacctgcctcctttgagcaggagaggcagcgggcccagaggcagggtgaggaagaggccgagtgccacaggcagttccgggcacagcctgtgcctgcacatgtctacctgcccctctaccaagagatcatggagcgcagcgaggcccgaaggcaggcagggatccaga

SEQ ID NO: 279403 - DNA, 399 bp, Homo sapiens
gctttactgggagccagtggtcgtttaggtctctgttccctcacctgcaaaattaagttgactctaaggtcaactttggtcacctcctagttcacattgtctaacagtagcccgtactccccaatctggtatcctttgtctcctgaaaggacccagcagtccaaggtccaagggaggaattcagaagcaacactgtttaatctagaaaaatacgttaaattgctgggctgagactgacagtcaaaggtcccaaagcaaaaacaactgagagtcccatgatactggcctagctgcttttctaatatttgccttactcagcggacacagcagaaagaaagaaggaattaaaaactgctggacttggagcacaatggtcaaggccacacatgacacgtcact

SEQ ID NO: 279404 - DNA, 558 bp, Homo sapiens
atttttttgaagtacactttttgtttaattccatgcatttgtttgctttgatagtcattcttgttcccattgccgttcaatacagagagggagccggcatcagaaaacaacactgggagctggggactgacagtacaggagaccagaggggagccaggtaaggaggttcattcggagacctaaccacaaaagagaaattcattcgctccaagtcgataggagctcaaattactgtaataaagcgtcaaagagggtcttcccacttccagagtctgggaagtggtcactctgaaggtgaagagccactggggtgatatgggcaagatgggacatcttcctaatagcttgcacatgctggctggggttcccttggcctgcagtcactggaggaccctgtccacctggtcactggacagcagcctagggccgggagccagcgatccctgagtgctgtgaagtggctctggagagcagacctgggatgctgccgggagcttccttacagtggccttgccatctgcttagggctctgctctgtgaagtcctgccatcgtaccc

SEQ ID NO: 279405 - DNA, 812 bp, Homo sapiens
tctcctgcagaacgtgcgactgagcggatgggactacaggcgcgtgcacatgcccggataattttttgtatttttggtagagacagggtttcactgtgttggccaggatggtttggatctcctgaccttgtgatccatctgcctcggcctcccaaagtgctgggattacaggcatgagccactgcgcccggtggtaagtactttattaatacatctgttaatccatttagtcctcatgataacactatgagacagatgctattatcatccccattttacagagaggttaagtggcttgccaggtcccacagtaagtggaatgctacaatttgcattcaggcagtcagattcccggctttacacttagaaccactatgctagcctgcctctccaaaggcagtcctgaatatgaaataaagtgctatatgtcctatgatggcatcatccagggaagagtcagggtatggagtggggaggctcagacctttaaaataatttttttttttcagagacagggtctcactgttgctcaggctggagtgcagtggtgtgatcatagctcactgcagcctcaaactcctgggcttaagagaaccttccacctcaagcctcccgagtagctgggactgcaggcatgtaccatcaaactcagctaattaaattttgttgttgttgttgttgtagaggcaaggtcttgctatgttgctcagactgatcttgaactcctgacccctaaagtgatcctcctgcctcagcctcccaaagtgctgggattgcaggtatgagctaccacacctgacctgggctcagac

SEQ ID NO: 279406 - DNA, 1032 bp, Homo sapiens
cgcgggctcagtccgcccgccgctgcgtcccggagtgcaagtgagcttctcggctgccccgcgggccggggtgcggagccgacatgcgcccgcttctcggcctccttctggtcttcgccggctgcaccttcgccttgtacttgctgtcgacgcgactgccccgcgggcggagactgggctccaccgaggaggctggaggcaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctgaatgttttagctggtgccttgtttgggccatggctggggcttctgctgtgctgtgtgttgacctcggtgggtgccacatgctgctacctgctctccagtatttttggcaaacagttggtggtgtcctactttcctgataaagtggccctgctgcagagaaaggtggaggagaacagaaacagcttgttttttttcttattgtttttgagacttttccccatgacaccaaactggttcttgaacctctcggccccaattctgaacattcccatcgtgcagttcttcttctcagttcttatcgaggcaaggtcttgctatgttgctcagactgatcttgaactcctgacccctaaagtgatcctcctgcctcagcctcccaaagtgctgggattgcagcttgcccagagacatctgagtcttcacacggcgcacggcacactccttgtcagagagcccatccgagtgtgaggatatgtcaatgggaatctctggcgtctgggacagcaggtcgtctagcttctctgccaagcggtcttcaagtttatcagctaactcatcaggactgtttgagtggtcactggtatttccctcttctccatcagacacagagaaattctcagagctaaaggttgaatatgactggcagctgctgatacagcgatggggcctagaacca

SEQ ID NO: 279407 - DNA, 460 bp, Homo sapiens
atttttttgaagtacactttttgtttaattccatgcatttgtttgctttgatagtcattcttgttcccattgccgttcaatacagagagggagccggcatcagaaaacaacactgggagctggggactgacagtacaggagaccagaggggagccaggtaaggaggttcattcggagacctaaccacaaaagagaaattcatacctggtcccctgttcaagcagcaataatacctcccggccccacaaattcccaaggatgttgctcttaaattccacttatttctttttttctgttctttcttttatctctttttttttttgcaagaaattattgtctctctatctcatatatagttcactctttgcagtacaaagtgttaaaatgtcaaacaaaaataaatatcaatgttacagtagctagaatattcaataaaatagatccctgccattcttgattg

SEQ ID NO: 279408 - DNA, 3128 bp, Homo sapiens
cgcgggctcagtccgcccgccgctgcgtcccggagtgcaagtgagcttctcggctgccccgcgggccggggtgcggagccgacatgcgcccgcttctcggcctccttctggtcttcgccggctgcaccttcgccttgtacttgctgtcgacgcgactgccccgcgggcggagactgggctccaccgaggaggctggaggcaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctgaatgttttagctggtgccttgtttgggccatggctggggcttctgctgtgctgtgtgttgacctcggtgggtgccacatgctgctacctgctctccagtatttttggcaaacagttggtggtgtcctactttcctgataaagtggccctgctgcagagaaaggtggaggagaacagaaacagcttgttttttttcttattgtttttgagacttttccccatgacaccaaactggttcttgaacctctcggccccaattctgaacattcccatcgtgcagttcttcttctcagttcttatcggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgacaaaaaaaaaaaaaaaaaagagaaaaaaagaaaatgctgtttgtattttgtggtctaataaggagttcgggatagcctgttgtatttgcctcatgccagcccctgagctgccttgggagaagatgctgattgtccttgtccagagtactgcttttgcagagtgacaggctgctgggacagatgtcctcctgttgcatctttgtggatgtttagtaccaatgatgacacgggaactcacatcactgacaccgctcttcatcttctgttagtctcttgaagagcatttttttgtacttctttgctgatgacctacctcttcataagccaagtgaaacaagttgacgaactgcctaggacttccacgtgttgctcacatacatgatgatttctgtcacgctcttgtgttcagacacactgacattaccatgtatgtcagacctccttatgatcgcatgtcctgacagttaagctgattgcaaacagactattaaatatgaatggagcaaacgctgtatgtcatggatatgttctggagaaattcttacccatctggatggggcagggcccttgactcacctgaatcatgaccaggcaaacattttatctgtcctttctgcaggaatccgttctgtgtcatgctaggagaatgggttcagtatatggggccatcaggcagtataccctctgaatgtttttcattgttgtatttgcttagagtaactaaacaattgtatcttttaatttatcttttaattcaaagaggaaaccttggcttctgataactttgttgtgttgtatcttaatggcctatagctgtcattacttcctgtagctgcagtacagaattgttacagacctggattaatgcttccaaagacagaaggaccttggcacctaaactgaccagccctgtgatcctgcaccccacaggagtaactcatcaggacttaccagactgctgcttttgggcatcatctgctgggttgatgatttggtttggccaagagtcttgccaagactttaatctatgcctcttgttctacatgaattcttgggaattactcacgttccataggaagagtgcatccccagagagggagccggcatcagaaaacaacactgggagctggggactgacagtacaggagaccagaggggagccaggaagtggtcagcaggcagaaaggaaatgagctacaaggaaatggcacttgagtatgaaagatcaacacgttgggtcaaggtagcacatttgccaagaggaagcacatgcccttgaagacattgggtgcaagtatctggtcaccagacttttgtaggtcatttccgtaagccacctggacaagctggttgaagtgaatatggtctgttcacaagttgcctggaattgcttttcttttgctgtgctttgtgttctaaaatgttcaatgtcttgctctggctcttctttagtcacttatggccaaaagacctggtcccctgttcaagcagcaataatacctcccggccccacaaattcccaaggatgttgctcttaaattccacttatttctttttttctgttctttcttttatctctttttttttttgcaagaaattattgtctctctatctcatatatagttcactctttgcagtacaaagtgttaaaatgtcaaacaaaaataaatatcaatgttacagtagctagaatattcaataaaatagatccctgccattcttgattg

SEQ ID NO: 279409 - DNA, 2318 bp, Homo sapiens
cgcgggctcagtccgcccgccgctgcgtcccggagtgcaagtgagcttctcggctgccccgcgggccggggtgcggagccgacatgcgcccgcttctcggcctccttctggtcttcgccggctgcaccttcgccttgtacttgctgtcgacgcgactgccccgcgggcggagactgggctccaccgaggaggctggaggcaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgacaaaaaaaaaaaaaaaaaagagaaaaaaagaaaatgctgtttgtattttgtggtctaataaggagttcgggatagcctgttgtatttgcctcatgccagcccctgagctgccttgggagaagatgctgattgtccttgtccagagtactgcttttgcagagtgacaggctgctgggacagatgtcctcctgttgcatctttgtggatgtttagtaccaatgatgacacgggaactcacatcactgacaccgctcttcatcttctgttagtctcttgaagagcatttttttgtacttctttgctgatgacctacctcttcataagccaagtgaaacaagttgacgaactgcctaggacttccacgtgttgctcacatacatgatgatttctgtcacgctcttgtgttcagacacactgacattaccatgtatgtcagacctccttatgatcgcatgtcctgacagttaagctgattgcaaacagactattaaatatgaatggagcaaacgctgtatgtcatggatatgttctggagaaattcttacccatctggatggggcagggcccttgactcacctgaatcatgaccaggcaaacattttatctgtcctttctgcaggaatccgttctgtgtcatgctaggagaatgggttcagtatatggggccatcaggcagtataccctctgaatgtttttcattgttgtatttgcttagagtaactaaacaattgtatcttttaatttatcttttaattcaaagaggaaaccttggcttctgataactttgttgtgttgtatcttaatggcctatagctgtcattacttcctgtagctgcagtacagaattgttacagacctggattaatgcttccaaagacagaaggaccttggcacctaaactgaccagccctgtgatcctgcaccccacaggagtaactcatcaggacttaccagactgctgcttttgggcatcatctgctgggttgatgatttggtttggccaagagtcttgccaagactttaatctatgcctcttgttctacatgaattcttgggaattactcacgttccataggaagagtgcatccccaggtgatggtttttggttatggtatgatcctttcacaccgaggatttcattgtttaaaacgtgtttctttaaaagaagccttgataacgagagtgggggaaggaggcagcagactttgaagactgtgg

SEQ ID NO: 279410 - DNA, 2186 bp, Homo sapiens
aatatctcaagttcttttgttgaacaagacaggcatatatgggaagtgaggaaaggagggaaaataatagaaaagaaggaaagaagggaaagagttaatatgtataagggtcaagagtcaagcaaaaaaaaaccgtagtcactgttcctggtgacattctgaattattattttcttaattttgctgctgcttgtaacaggtgctttgtccttttcttcttccaggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgacaaaaaaaaaaaaaaaaaagagaaaaaaagaaaatgctgtttgtattttgtggtctaataaggagttcgggatagcctgttgtatttgcctcatgccagcccctgagctgccttgggagaagatgctgattgtccttgtccagagtactgcttttgcagagtgacaggctgctgggacagatgtcctcctgttgcatctttgtggatgtttagtaccaatgatgacacgggaactcacatcactgacaccgctcttcatcttctgttagtctcttgaagagcatttttttgtacttctttgctgatgacctacctcttcataagccaagtgaaacaagttgacgaactgcctaggacttccacgtgttgctcacatacatgatgatttctgtcacgctcttgtgttcagacacactgacattaccatgtatgtcagacctccttatgatcgcatgtcctgacagttaagctgattgcaaacagactattaaatatgaatggagcaaacgctgtatgtcatggatatgttctggagaaattcttacccatctggatggggcagggcccttgactcacctgaatcatgaccaggcaaacattttatctgtcctttctgcaggaatccgttctgtgtcatgctaggagaatgggttcagtatatggggccatcaggcagtataccctctgaatgtttttcattgttgtatttgcttagagtaactaaacaattgtatcttttaatttatcttttaattcaaagaggaaaccttggcttctgataactttgttgtgttgtatcttaatggcctatagctgtcattacttcctgtagctgcagtacagaattgttacagacctggattaatgcttccaaagacagaaggaccttggcacctaaactgaccagccctgtgatcctgcaccccacaggagtaactcatcaggacttaccagactgctgcttttgggcatcatctgctgggttgatgatttggtttggccaagagtcttgccaagactttaatctatgcctcttgttctacatgaattcttgggaattactcacgttccataggaagagtgcatccccaggtgatggtttttggttatggtatgatcctttcacaccgaggatttcattgtttaaaacgtgtttctttaaaagaagccttgataacgagagtgggggaaggaggcagcagactttgaagactgtgg

SEQ ID NO: 279411 - DNA, 956 bp, Homo sapiens
gcggcggacatctagaggacccgcgatgagtaaacttgggtgatgacctacctcttcataagccaagtgaaacaagttgacgaactgcctaggacttccacgtgttgctcacatacatgatgatttctgtcacgctcttgtgttcagacacactgacattaccatgtatgtcagacctccttatgatcgcatgtcctgacagttaagctgattgcaaacagactattaaatatgaatggagcaaacgctgtatgtcatggatatgttctggagaaattcttacccatctggatggggcagggcccttgactcacctgaatcatgaccaggcaaacattttatctgtcctttctgcaggaatccgttctgtgtcatgctaggagaatgggttcagtatatggggccatcaggcagtataccctctgaatgtttttcattgttgtatttgcttagagtaactaaacaattgtatcttttaatttatcttttaattcaaagaggaaaccttggcttctgataactttgttgtgttgtatcttaatggcctatagctgtcattacttcctgtagctgcagtacagaattgttacagacctggattaatgcttccaaagacagaaggaccttggcacctaaactgaccagccctgtgatcctgcaccccacaggagtaactcatcaggacttaccagactgctgcttttgggcatcatctgctgggttgatgatttggtttggccaagagtcttgccaagactttaatctatgcctcttgttctacatgaattcttgggaattactcacgttccataggaagagtgcatccccaggtgatggtttttggttatggtatgatcctttcacaccgaggatttcattgtttaaaacgtgtttctttaaaagaagccttgataacgagagtgggggaaggaggcagcagactttgaagactgtgg

SEQ ID NO: 279412 - DNA, 624 bp, Homo sapiens
tgacagtgacagcactaaaaagggacgtatttgccaaaaacaagatttgacactatctgtaaacctcactaccaactgctgcttaaacatttaaaaatgaaaccagcttccacatacacaggtttgtttgtttgtttgtttgtctgtttttccctcctagaggaagcacatgcccttgaagacattgggtgcaagtatctggtcaccagacttttgtaggtcatttccgtaagccacctggacaagctggttgaagtgaatatggtctgttcacaagttgcctggaattgcttttcttttgctgtgctttgtgttctaaaatgttcaatgtcttgctctggctcttctttagtcacttatggccaaaagacctggtcccctgttcaagcagcaataatacctcccggccccacaaattcccaaggatgttgctcttaaattccacttatttctttttttctgttctttcttttatctctttttttttttgcaagaaattattgtctctctatctcatatatagttcactctttgcagtacaaagtgttaaaatgtcaaacaaaaataaatatcaatgttacagtagctagaatattcaataaaatagatccctgccattcttga

SEQ ID NO: 279413 - DNA, 2619 bp, Homo sapiens
cgcgggctcagtccgcccgccgctgcgtcccggagtgcaagtgagcttctcggctgccccgcgggccggggtgcggagccgacatgcgcccgcttctcggcctccttctggtcttcgccggctgcaccttcgccttgtacttgctgtcgacgcgactgccccgcgggcggagactgggctccaccgaggaggctggaggcaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctgaatgttttagctggtgccttgtttgggccatggctggggcttctgctgtgctgtgtgttgacctcggtgggtgccacatgctgctacctgctctccagtatttttggcaaacagttggtggtgtcctactttcctgataaagtggccctgctgcagagaaaggtggaggagaacagaaacagcttgttttttttcttattgtttttgagacttttccccatgacaccaaactggttcttgaacctctcggccccaattctgaacattcccatcgtgcagttcttcttctcagttcttatcggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgacaaaaaaaaaaaaaaaaaagagaaaaaaagaaaatgctgtttgtattttgtggtctaataaggagttcgggatagcctgttgtatttgcctcatgccagcccctgagctgccttgggagaagatgctgattgtccttgtccagagtactgcttttgcagagtgacaggctgctgggacagatgtcctcctgttgcatctttgtggatgtttagtaccaatgatgacacgggaactcacatcactgacaccgctcttcatcttctgttagtctcttgaagagcatttttttgtacttctttgctgatgacctacctcttcataagccaagtgaaacaagttgacgaactgcctaggacttccacgtgttgctcacatacatgatgatttctgtcacgctcttgtgttcagacacactgacattaccatgtatgtcagacctccttatgatcgcatgtcctgacagttaagctgattgcaaacagactattaaatatgaatggagcaaacgctgtatgtcatggatatgttctggagaaattcttacccatctggatggggcagggcccttgactcacctgaatcatgaccaggcaaacattttatctgtcctttctgcaggaatccgttctgtgtcatgctaggagaatgggttcagtatatggggccatcaggcagtataccctctgaatgtttttcattgttgtatttgcttagagtaactaaacaattgtatcttttaatttatcttttaattcaaagaggaaaccttggcttctgataactttgttgtgttgtatcttaatggcctatagctgtcattacttcctgtagctgcagtacagaattgttacagacctggattaatgcttccaaagacagaaggaccttggcacctaaactgaccagccctgtgatcctgcaccccacaggagtaactcatcaggacttaccagactgctgcttttgggcatcatctgctgggttgatgatttggtttggccaagagtcttgccaagactttaatctatgcctcttgttctacatgaattcttgggaattactcacgttccataggaagagtgcatccccaggtgatggtttttggttatggtatgatcctttcacaccgaggatttcattgtttaaaacgtgtttctttaaaagaagccttgataacgagagtgggggaaggaggcagcagactttgaagactgtgg

SEQ ID NO: 279414 - DNA, 2966 bp, Homo sapiens
cgcgggctcagtccgcccgccgctgcgtcccggagtgcaagtgagcttctcggctgccccgcgggccggggtgcggagccgacatgcgcccgcttctcggcctccttctggtcttcgccggctgcaccttcgccttgtacttgctgtcgacgcgactgccccgcgggcggagactgggctccaccgaggaggctggaggcaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctgaatgttttagctggtgccttgtttgggccatggctggggcttctgctgtgctgtgtgttgacctcggtgggtgccacatgctgctacctgctctccagtatttttggcaaacagttggtggtgtcctactttcctgataaagtggccctgctgcagagaaaggtggaggagaacagaaacagcttgttttttttcttattgtttttgagacttttccccatgacaccaaactggttcttgaacctctcggccccaattctgaacattcccatcgtgcagttcttcttctcagttcttatcggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgacaaaaaaaaaaaaaaaaaagagaaaaaaagaaaatgctgtttgtattttgtggtctaataaggagttcgggatagcctgttgtatttgcctcatgccagcccctgagctgccttgggagaagatgctgattgtccttgtccagagtactgcttttgcagagtgacaggctgctgggacagatgtcctcctgttgcatctttgtggatgtttagtaccaatgatgacacgggaactcacatcactgacaccgctcttcatcttctgttagtctcttgaagagcatttttttgtacttctttgctgatgacctacctcttcataagccaagtgaaacaagttgacgaactgcctaggacttccacgtgttgctcacatacatgatgatttctgtcacgctcttgtgttcagacacactgacattaccatgtatgtcagacctccttatgatcgcatgtcctgacagttaagctgattgcaaacagactattaaatatgaatggagcaaacgctgtatgtcatggatatgttctggagaaattcttacccatctggatggggcagggcccttgactcacctgaatcatgaccaggcaaacattttatctgtcctttctgcaggaatccgttctgtgtcatgctaggagaatgggttcagtatatggggccatcaggcagtataccctctgaatgtttttcattgttgtatttgcttagagtaactaaacaattgtatcttttaatttatcttttaattcaaagaggaaaccttggcttctgataactttgttgtgttgtatcttaatggcctatagctgtcattacttcctgtagctgcagtacagaattgttacagacctggattaatgcttccaaagacagaaggaccttggcacctaaactgaccagccctgtgatcctgcaccccacaggagtaactcatcaggacttaccagactgctgcttttgggcatcatctgctgggttgatgatttggtttggccaagagtcttgccaagactttaatctatgcctcttgttctacatgaattcttgggaattactcacgttccataggaagagtgcatccccagagagggagccggcatcagaaaacaacactgggagctggggactgacagtacaggagaccagaggggagccaggtaaggaggttcattcggagacctaaccacaaaagagaaattcattcgctccaagtcgataggagctcaaattactgtaataaagcgtcaaagagggtcttcccacttccagagtctgggaagtggtcactctgaaggtgaagagccactggggtgatatgggcaagatgggacatcttcctaatagcttgcacatgctggctggggttcccttggcctgcagtcactggaggaccctgtccacctggtcactggacagcagcctagggccgggagccagcgatccctgagtgctgtgaagtggctctggagagcagacctgggatgctgccgggagcttccttacagtggccttgccatctgcttagggctctgctctgtgaagtcctgccatcgtaccc

SEQ ID NO: 279415 - DNA, 862 bp, Homo sapiens
cagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcctgccccctgctggccccgctgaacgacaccagggtggtgcacgccgcgaaagctgccctggccgccttcaacgctcagaacaacggctccaattttcagctggaggaaatttcccgggctcagcttgtgatagtgcctcccacttctactatgtggggttacctgtttgcgacgatgtgtggtaagaggcactaggaggcattgtacctggggtgaaagatatggtttgtatgcgctcacgctatgggcacgtgtggctgagggtcacagcggaccaccactaggtttattccaccgggggaaccccggggt

SEQ ID NO: 279416 - DNA, 803 bp, Homo sapiens
tgcaaatcccctctccctgtggatcacggcaagccttcttttagggtgtcacctcatccctttaagagctgtcatcaaatcatctcacccactggaagcacatgaagttaggagaaagagagaggctatttgctaatgaagccaagtcacgcccacccactgggaatgtgaagtgcacattttctagacatataactctgatacaaaagctttcaagtccttgagccaataatgtacacttctaggattttagtctaaagaagtcatcagtggccaggcatgatggctcatgcctgtaattccagcactttgggaggccaagacgggtggatcgggaggtcaggagatcgagaccatcctggctaacatggtgaaaccccgtctctactaaaaatacaaaaaaattagccaggcttggtggtgagcgcctgtagtcccagctactcgggaggctgaggcaggagaatggtgtgaacccaggaggcagatgttgcagtaaactaagatcgtgccactgcactccagcctgggcaacagaacgagactctgtctcaagaaaaaaagaaagcgccatcacgaggtgctcatcccaggcacctttgccagtcccacagctgccggcaggtacatccccactccctccgttccagctccaaagctcagtgtcagctggtagagttgcccacgtcggccagaagcactcactgttttgctgggctccagtaccacccatctccgctgaacatctgccacagactcgtaattaatactcacttgtgctgacaagcttataatggcgtctt

SEQ ID NO: 279417 - DNA, 721 bp, Homo sapiens
tcaaaataagccttgtgcttgttattccctacccaatgggtgccattgaaccagtcctgcaccccgggtgaaccagatgctcttcagtcccttccacttggagcacctggactcctctatagggctaaccccaaacttctaatgtgttaagacagttcttcagggactcaagtggcgccggggcactagttcgtgaaccacacttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaa

SEQ ID NO: 279418 - DNA, 1635 bp, Homo sapiens
cagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaa

SEQ ID NO: 279419 - DNA, 2821 bp, Homo sapiens
cagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgggtaaagactgagattcttttgacaggttgggcagttcggtggcacttcgggaatgtactgtacgtggtggagcgggaggcagggaagaacaggcgcaggggcagcgatgagaaagcaaggagagggttgtttggaaagggaagaaagcatcctaagggggtatgaggctcctgagtgtcatgaggaccccaacaccctcagcgcctcccccatgctgagccactgtaacgtccagcagccacagctgccggcaggtacatccccactccctccgttccagctaaaaccaaagctcagtgtcagctggtagagttgcccacgtcggccagaagcactcactgtaaatttgctgggctccagtaccacccatctccgctgaacatctgccacagactcgtaattaatactcacttgtgctgacaagcttataatggcaagatcttaaaatgcctttcgagtcactggagaaaacatctcattgtactgtgggtggtttagcacattggaattcaacagaattcaaatgtttaagaaaatgtattctggatatcagccatggccatacttggaaatacgctagtatagacggcaattctattaatcagaatatgtgattctcagaacatccccaccccagactacaccaaataacagatattttattgtgtccatatgctccaactactttaaaaaagaaaagctcaagtgatatcttccatactttcatctaaatcttttcatttgagcctgctctatgaaacaggtggaagaggtattaatctcttcactttcccaccctattttggaataacctgaaccttgggtatcaagtgcagcccaagagtgagggctggggggaggcagggttcccactcctatcagtctaatgctggccttctgattccggtttcctatctgcaaactcacctccaccctgaaggaccggtgatggatacttgcccctcctacaaggaagacacaacccctacctctaaagcacaagcacttgagaacacaaccccatagcaactgccctatgtaagccattgagggacatgtcttctgggccgacgcatggtctgcatgaatggtgctccccgaaggaggctacttcccgctctccttctctgcccttttcattgtaagtcatctttcctcaagagcattttcatgtactcttctcagcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaa

SEQ ID NO: 279420 - DNA, 2766 bp, Homo sapiens
cagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgggtaaagactgagattcttttgacaggttgggcagttcggtggcacttcgggaatgtactgtacgtggtggagcgggaggcagggaagaacaggcgcaggggcagcgatgagaaagcaaggagagggttgtttggaaagggaagaaagcatcctaagggggtatgaggctcctgagtgtcatgaggaccccaacaccctcagcgcctcccccatgctgagccactgtaacgtccagcagccacagctgccggcaggtacatccccactccctccgttccagtcactgtaaatttgctgggctccagtaccacccatctccgctgaacatctgccacagactcgtaattaatactcacttgtgctgacaagcttataatggcaagatcttaaaatgcctttcgagtcactggagaaaacatctcattgtactgtgggtggtttagcacattggaattcaacagaattcaaatgtttaagaaaatgtattctggatatcagccatggccatacttggaaatacgctagtatagacggcaattctattaatcagaatatgtgattctcagaacatccccaccccagactacaccaaataacagatattttattgtgtccatatgctccaactactttaaaaaagaaaagctcaagtgatatcttccatactttcatctaaatcttttcatttgagcctgctctatgaaacaggtggaagaggtattaatctcttcactttcccaccctattttggaataacctgaaccttgggtatcaagtgcagcccaagagtgagggctggggggaggcagggttcccactcctatcagtctaatgctggccttctgattccggtttcctatctgcaaactcacctccaccctgaaggaccggtgatggatacttgcccctcctacaaggaagacacaacccctacctctaaagcacaagcacttgagaacacaaccccatagcaactgccctatgtaagccattgagggacatgtcttctgggccgacgcatggtctgcatgaatggtgctccccgaaggaggctacttcccgctctccttctctgcccttttcattgtaagtcatctttcctcaagagcattttcatgtactcttctcagcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaa

SEQ ID NO: 279421 - DNA, 1573 bp, Homo sapiens
cagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaacagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaa

SEQ ID NO: 279422 - DNA, 2800 bp, Homo sapiens
cagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgggtaaagactgagattcttttgacaggttgggcagttcggtggcacttcgggaatgtactgtacgtggtggagcgggaggcagggaagaacaggcgcaggggcagcgatgagaaagcaaggagagggttgtttggaaagggaagaaagcatcctaagggggtatgaggctcctgagtgtcatgaggaccccaacaccctcagcgcctcccccatgctgagccactgtaacgtccagcagccacagctgccggcaggtacatccccactccctccgttccagctaaaaccaaagctcagtgtcagctggtagagttgcccacgtcggccagaagcactcactgtaaatttgctgggctccagtaccacccatctccgctgaacatctgccacagactcgtaattaatactcacttgtgctgacaagcttataatggcaagatcttaaaatgcctttcgagtcactggagaaaacatctcattgtactgtgggtggtttagcacattggaattcaacagaattcaaatgtttaagaaaatgtattctggatatcagccatggccatacttggaaatacgctagtatagacggcaattctattaatcagaatatgtgattctcagaacatccccaccccagactacaccaaataacagatattttattgtgtccatatgctccaactactttaaaaaagaaaagctcaagtgatatcttccatactttcatctaaatcttttcatttgagcctgctctatgaaacaggtggaagaggtattaatctcttcactttcccaccctattttggaataacctgaaccttgggtatcaagtgcagcccaagagtgagggctggggggaggcagggttcccactcctatcagtctaatgctggccttctgattccggtttcctatctgcaaactcacctccaccctgaaggaccggtgatggatacttgcccctcctacaaggaagacacaacccctacctctaaagcacaagcacttgagaacacaaccccatagcaactgccctatgtaagccattgagggacatgtcttctgggccgacgcatggtctgcatgaatggtgctccccgaaggaggctacttcccgctctccttctctgcccttttcattgtaagtcatctttcctcaagagcattttcatgtactcttctcagcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaa

SEQ ID NO: 279423 - DNA, 1826 bp, Homo sapiens
cagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcctgccccctgctggccccgctgaacgacaccagggtggtgcacgccgcgaaagctgccctggccgccttcaacgctcagaacaacggctccaattttcagctggaggaaatttcccgggctcagcttgtggaccggtgatggatacttgcccctcctacaaggaagacacaacccctacctctaaagcacaagcacttgagaacacaaccccatagcaactgccctatgtaagccattgagggacatgtcttctgggccgacgcatggtctgcatgaatggtgctccccgaaggaggctacttcccgctctccttctctgcccttttcattgtaagtcatctttcctcaagagcattttcatgtactcttctcagcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaa

SEQ ID NO: 279424 - DNA, 1639 bp, Homo sapiens
tgcaaatcccctctccctgtggatcacggcaagccttcttttagggtgtcacctcatccctttaagagctgtcatcaaatcatctcacccactggaagcacatgaagttaggagaaagagagaggctatttgctaatgaagccaagtcacgcccacccactgggaatgtgaagtgcacattttctagacatataactctgatacaaaagctttcaagtccttgagccaataatgtacacttctaggattttagtctaaagaagtcatcagtggccaggcatgatggctcatgcctgtaattccagcactttgggaggccaagacgggtggatcgggaggtcaggagatcgagaccatcctggctaacatggtgaaaccccgtctctactaaaaatacaaaaaaattagccaggcttggtggtgagcgcctgtagtcccagctactcgggaggctgaggcaggagaatggtgtgaacccaggaggcagatgttgcagtaaactaagatcgtgccactgcactccagcctgggcaacagaacgagactctgtctcaagaaaaaaagaaaaagaaaaagaattcatcagtgacatttgacagaatatatctataaaaatgatttattatggatataaagagaccaaaaaagagagatctgtatgtccaacaggaaggtgtcattgaataatccatgcacatcagtaaatagaaaattgtgcagacactaaaaattgtgttttcaaggaataatgaatgatatgagaaaatgctattatggcaagtgaaaacacacaggatacaacatcgtatagtcacaatgatctcaatttttaaatcatatttaatagtattttaaaataagaaagaaatgcatcaatgttaacagtccttctttctaggccaccaccagaaagggattatgggtaatctctctcactctcaaagtatttctgtatttccatgttatatatagaatcatatacctcccacaagcagaaactataactttaagaaaaatggtttttcaaactaatttaaggttggcgcgtcaatgaaattgggggggatccatttttgaaattagttaaaataaatcctctttctctgtgggcagcaatatggcttttgtaaggcaacactcagtgagaagcttggtggggcagaggttgcagtgacctgcacggtgttccaaacacaggtaacagctccgtgaatattcttgcctacaccttcagaatacaatgaccccttcacatttatgcagtgcagtagtgatgacaggacatttgctaatgaagccaagtcacgcccacccactgggaatgtgaagtgcacattttctagacatataactctgatacaaaagctttcaagtccttgagccaataatgtacacttctaggattttagtctaaagaagtcatcagtcgccggtcgtggtggctcatgcctgtaatcccaacactttgggaggctgaggacggcggatcacgaggacaagagattgagaccatcctggccaacatggtgaaaccccatctctactaaaaatacaaaaaattagctgtgcatggtggcgcacacctgtagtcccagctactcaggaggtggaggcaggagaatcgcttgaacctaggagg

SEQ ID NO: 279425 - DNA, 1586 bp, Homo sapiens
tgcaaatcccctctccctgtggatcacggcaagccttcttttagggtgtcacctcatccctttaagagctgtcatcaaatcatctcacccactggaagcacatgaagttaggagaaagagagaggctatttgctaatgaagccaagtcacgcccacccactgggaatgtgaagtgcacattttctagacatataactctgatacaaaagctttcaagtccttgagccaataatgtacacttctaggattttagtctaaagaagtcatcagtggccaggcatgatggctcatgcctgtaattccagcactttgggaggccaagacgggtggatcgggaggtcaggagatcgagaccatcctggctaacatggtgaaaccccgtctctactaaaaatacaaaaaaattagccaggcttggtggtgagcgcctgtagtcccagctactcgggaggctgaggcaggagaatggtgtgaacccaggaggcagatgttgcagtaaactaagatcgtgccactgcactccagcctgggcaacagaacgagactctgtctcaagaaaaaaagaaaaagaaaaagaattcatcagtgacatttgacagaatatatctataaaaatgatttattatggatataaagagaccaaaaaagagagatctgtatgtccaacaggaaggtgtcattgaataatccatgcacatcagtaaatagaaaattgtgcagacactaaaaattgtgttttcaaggaataatgaatgatatgagaaaatgctattatggcaagtgaaaacacacaggatacaacatcgtatagtcacaatgatctcaatttttaaatcatatttaatagtattttcagaaagggattatgggtaatctctctcactctcaaagtatttctgtatttccatgttatatatagaatcatatacctcccacaagcagaaactataactttaagaaaaatggtttttcaaactaatttaaggttggcgcgtcaatgaaattgggggggatccatttttgaaattagttaaaataaatcctctttctctgtgggcagcaatatggcttttgtaaggcaacactcagtgagaagcttggtggggcagaggttgcagtgacctgcacggtgttccaaacacaggtaacagctccgtgaatattcttgcctacaccttcagaatacaatgaccccttcacatttatgcagtgcagtagtgatgacaggacatttgctaatgaagccaagtcacgcccacccactgggaatgtgaagtgcacattttctagacatataactctgatacaaaagctttcaagtccttgagccaataatgtacacttctaggattttagtctaaagaagtcatcagtcgccggtcgtggtggctcatgcctgtaatcccaacactttgggaggctgaggacggcggatcacgaggacaagagattgagaccatcctggccaacatggtgaaaccccatctctactaaaaatacaaaaaattagctgtgcatggtggcgcacacctgtagtcccagctactcaggaggtggaggcaggagaatcgcttgaacctaggagg

SEQ ID NO: 279426 - DNA, 1804 bp, Homo sapiens
tgcaaatcccctctccctgtggatcacggcaagccttcttttagggtgtcacctcatccctttaagagctgtcatcaaatcatctcacccactggaagcacatgaagttaggagaaagagagaggctatttgctaatgaagccaagtcacgcccacccactgggaatgtgaagtgcacattttctagacatataactctgatacaaaagctttcaagtccttgagccaataatgtacacttctaggattttagtctaaagaagtcatcagtggccaggcatgatggctcatgcctgtaattccagcactttgggaggccaagacgggtggatcgggaggtcaggagatcgagaccatcctggctaacatggtgaaaccccgtctctactaaaaatacaaaaaaattagccaggcttggtggtgagcgcctgtagtcccagctactcgggaggctgaggcaggagaatggtgtgaacccaggaggcagatgttgcagtaaactaagatcgtgccactgcactccagcctgggcaacagaacgagactctgtctcaagaaaaaaagaaaaagaaaaagaattcatcagtgacatttgacagaatatatctataaaaatgatttattatggatataaagagaccaaaaaagagagatctgtatgtccaacaggaaggtgtcattgaataatccatgcacatcagtaaatagaaaattgtgcagacactaaaaattgtgttttcaaggaataatgaatgatatgagaaaatgctattatggcaagtgaaaacacacaggatacaacatcgtatagtcacaatgatctcaatttttaaatcatatttaatagtattttaaaataagaaagaaatgcatcaatgttaacagtccttctttctaggccaccaccagaaagggattatgggtaatctctctcactctcaaagtatttctgtatttccatgttatatatagaatcatatacctcccacaagcagaaactataactttaagaaaaatggtttttcaaactaatttaaggttggcgcgtcaatgaaattgggggggatccatttttgaaattagttcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacacctttcatggtgtggtctcattggggtcacctcaggagaagttgttgtatcccggcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaa

SEQ ID NO: 279427 - DNA, 883 bp, Homo sapiens
  misc_feature (883)..(883): n is a, c, g, or t
cagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcctgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcgcagtgtactgtggggaaacattgcttgtaggacacataaagctggggcagtgcgacgtcggtccgcggccagcacagttgagacccgtgggcccgggaccggcccctgctctggtgccttcgggggtgn

SEQ ID NO: 279428 - DNA, 474 bp, Homo sapiens
cagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaacagccctccggagagctgtttgagattgaaatagacaccctggaaaccacctgccatgtgctggaccccacccctgtggcaagatgcagcgtgaggcagctgaaggagcatgctgtcgagacactgagattcacctctggagactctatagcgcggttccgcg

SEQ ID NO: 279429 - DNA, 1580 bp, Homo sapiens
cagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacacctttcatggtgtggtctcattggggtcacctcaggagaagttgttgtatcccggcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaa

SEQ ID NO: 279430 - DNA, 1531 bp, Homo sapiens
cagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacacctttcatggtgtggtctcattggggtcacctcaggagaagttgttgtatcccggcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaa

SEQ ID NO: 279431 - DNA, 2767 bp, Homo sapiens
cagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcctgccccctgctggccccgctgaacgacaccagggtggtgcacgccgcgaaagctgccctggccgccttcaacgctcagaacaacggctccaattttcagctggaggaaatttcccgggctcagcttgtgggtaaagactgagattcttttgacaggttgggcagttcggtggcacttcgggaatgtactgtacgtggtggagcgggaggcagggaagaacaggcgcaggggcagcgatgagaaagcaaggagagggttgtttggaaagggaagaaagcatcctaagggggtatgaggctcctgagtgtcatgaggaccccaacaccctcagcgcctcccccatgctgagccactgtaacgtccagcagccacagctgccggcaggtacatccccactccctccgttccagctaaaaccaaagctcagtgtcagctggtagagttgcccacgtcggccagaagcactcactgtaaatttgctgggctccagtaccacccatctccgctgaacatctgccacagactcgtaattaatactcacttgtgctgacaagcttataatggcaagatcttaaaatgcctttcgagtcactggagaaaacatctcattgtactgtgggtggtttagcacattggaattcaacagaattcaaatgtttaagaaaatgtattctggatatcagccatggccatacttggaaatacgctagtatagacggcaattctattaatcagaatatgtgattctcagaacatccccaccccagactacaccaaataacagatattttattgtgtccatatgctccaactactttaaaaaagaaaagctcaagtgatatcttccatactttcatctaaatcttttcatttgagcctgctctatgaaacaggtggaagaggtattaatctcttcactttcccaccctattttggaataacctgaaccttgggtatcaagtgcagcccaagagtgagggctggggggaggcagggttcccactcctatcagtctaatgctggccttctgattccggtttcctatctgcaaactcacctccaccctgaaggaccggtgatggatacttgcccctcctacaaggaagacacaacccctacctctaaagcacaagcacttgagaacacaaccccatagcaactgccctatgtaagccattgagggacatgtcttctgggccgacgcatggtctgcatgaatggtgctccccgaaggaggctacttcccgctctccttctctgcccttttcattgtaagtcatctttcctcaagagcattttcatgtactcttctcagcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaa

SEQ ID NO: 279432 - DNA, 1581 bp, Homo sapiens
cagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcctgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaa

SEQ ID NO: 279433 - DNA, 5431 bp, Homo sapiens
  misc_feature (3282)..(3282): n is a, c, g, or t
  misc_feature (3621)..(3621): n is a, c, g, or t
gcggccgcctctgctgcggccggaaacaatagtggaggaacccgagccgcacggaacggcggtggtggcccgcggagccggacggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaattgaattcgatgactcttggtgaggtagagcaactgaatgcaaagctcctacagcaaatccaggaagtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactctagtcttctagggctaatcattttggctcatttggggactcttttttcccagaattactaaacaaattttatcacatgtgactacttaaatatactgttacagtgtcattttattaaacattttaattcacctgtcaaaacaacagattaactccttagtgtaaactactagagataatttttaagagggaaatggaattcatatcacctcttatttattatgagcaatattttaatataaaaattttatatgtgaaaatgctattttaggtactttgccattctctttataaatgtgtatttgagtggttctgtatatttatttacattatcatgtgtgaatatgttcacccatatttcaggtcactgcattttattctcttaatacaatgttttcacaacggttaccttgctttccaaagataaatatattttggattagaaatctgagttgttttaatttctaatacctcttataaaagaagaattaataactttttaaagcagtattcaggtaaatacaatacattattttgttttctaacaaaagcagttcttagttcaggaagaaaagactaatctggcttctatgtcaatttgtctccatagaaatgaaagcctcctcttgcttctttcattattagcttcacaccaatgactgtgatgcattagaatttggacagagtaagtcaagcctcacttccaattcaaatataatgtctatcttcaaattgagtgtgctgtgaaattgttctgtctttgaaaaaaaaaagtaagattattttgtgtgccactttgggtaaagtttcaagaatacttaaactgtccaaattgtattatcaccatcattgaacttagtgctcaaagaaagcattgtgaggtatttttctaaactttagactctatagagaaatataggattgttctacagaagaaaagcaaaactcctaattaaaaaaaaataaacctatgtattaagagaatgttctcgtaagttgcctatgatgcttccaaagagtttttatctaacagattgtgccaaacagctagataaattttaataatgtattacagtaaaggctataaccaatgcagaattaaaatgggctctaaattctgtttttaactcatgtttagaatgtacttatgaggtagatccttgcttgaaagtatctgctgaaaagcccagtaacgtggcagcttcatgcataaagatataaatgacatttgccttaaatttggcagcctaccctggcttgggtcagattttgttgttgaacacaagaaagtatttaagcaaagaaacacttcagtttaattgaaaacaactttttgtaatgctgacgtgttaaattggcctgagggtattaattgatatctgttgattttgtttttctttgaagtataacattactttttggagggaatttttgaaagatgctttcgatttctctcaattctttaagtcatgcaaaatgaatttaaaatccagggagtatggatgcattgccttagttttgatgagctttaaattaaatgtgtgcaatatcaaaatattcaaacttacaagctgggtaaatacatttcctgattaatatcttagtgcttaattgttcccacattttcaaatttgactttactcttttttggcgtaattcagtaagattgttaccagccagtgtgtttgcacacatttgggtttgtgtttagatgagttagggacagtcataaaagttggggatatgttgcatttgatatcaatagtagcatatttccagaatatgagccataagttgcagtcctgaatacaacagtgttatccaaagaaaggagttttctgacaaatatacatagctttgctaatgagtacggaacaagtggatgaacgtgtgcatgtgctaaggtcttaagtgggactctgatttattccatttagatatttctacttaagctctaaaaaggagaggtgctcttaaaaaaaactttgtggtgctggtactcacactactttatttggatgagttcctagtaaaaaaaactttttgttgaagtattttgcacagcagtttatccaaatgtttggtaaacttataatttagtcctatgttagttttcttaatcaaatatgcanttactgtgtatgcaaatataagtatcaggtacagagttctaacaagagaacatgaaatatcacaaatattgttttccacacttggctattctctacagttgttagtaatttttgagaatgttttgaagcatatctcatgtactactgtttaaaaagtggcaaaacagactgccagtcatccattactaaattttcagagcttatatgattaaggggagtgagataagacaaatctttttcacgttcagttttataatttgacacgttaaattgagttttaaaaattagaaaagtgtttttgaccacacaggttgttctctttaaagttcagccttatantgaagctaaaaatcaattatgttttactttgagattatcatcttatcctttgatcctcatattaatatctaaattagtcttttttaaaaggcatgcacttgagactccagtaatagatgattcaggcagcagaatagtgttttgttgtgtcgttgactatgcacaatggtggagcaaagacacattcttagtttttcaaaacacatgttcattttaccacaaagtgcccatttttatatacatttaaggattattttttcaatgtcaagttcatgttagtgatttcagaaatatagtcaaaatatatagtcaaatatatcttgacaggcatcttgagatttggtttttcattttactatatttatgactgaaaatggttttgtgttttctttatgttgtttatatattttttaccttagtgtttacactggtaaggcttgttagtccatttttgtagtttttttaaagtaagcttttagatctatttgtgttttaatgtttcccagtttgggttttgttttgttttggaagaatctgctttcattattaaattataaaatgtaaatgctctaaagtaggaatttttaaagagtaaattatttgtgtagcttattaggaggttcaggttagtgaccataaagtgggttacttgtacatgaaaatttgaaatggtaccatgtaaaattcttctattgtcaactttttctgatgtatgccagttcatttactgacaaatgttgttactaagtgcttattaagaagtgtaatacgctataaaaaagttaatactttttgttcagatgtaaggcaaagataattgatgccgtttcagtgtatgattgtatttttaacttttacgttggtgggagtaactatttgaggaaatttgtggtgagaattagtaagagataaaacccccaacagtttattcttaccaagtaaagttttgtggtcatggggcagggaagagtttatttaccagaatactagagccctcacacaaaataaaggtaacttggaggagggctataatgcttgcatctcagtattttcatttcacttcatcctttcataattgccttgattatggtgcagtctaacctattaagcaacttctggctatggtaacattgatatgaaccatattatatcaagtctccaaaacatctagtttgttaacatacactttccctgttctttttagtttgagtccacattactaatacattttaataatatttaattatttcacaattttaagtttaccaaagtaaacaaaaattcatgaagatgagtattgccctctcccaaaaaaggtttaaagattagttgaacttccctcaactacacctaaagcaaaggggaattttagtaagtgtgtgtaccttgtttctttcagacgcatctagaatgtttttctttcaccgtacctccaaaagaggcaatttagaaagtattaagtagtgacttttgttcagttccattttgtgtgtgtgtgtgtgtgtgtgtgtgtgtgtgtgaaccttgctttaaaacagtagcatatactatggtcattgaacttaatctctctggtgttagaaatttactttacaaaattgtgttaagacttttggaaaaagaaaatgaaactgctgtggtaaaaaccaagtttgtttcaaaaaagtaggcaattatttggctgttatattttctttgaaaactgcaataatttatatatttgtattgctctgcttgggaactgtatatatgcttgtctactatttttaattttacaacaataaaataagtattttgttaaaaaaaaaaa

SEQ ID NO: 279434 - DNA, 605 bp, Homo sapiens
ctgggggcggccgcgcgcccccaacgccgaaggccgggccaggacccggctccccgagacgctgaggctgggcggaccggccgccgtggccctcggacgctttcttccctctgggaggaatcccggagcgatgggacgagactctcccgcccgccgggctccaggatgccgcggctctcccagctccggcttgggcccctccggcggtgcccggccggtaccgtgaagccgccgctcggccttcggtgtagttgccccggacacggcgggacgccctccccgggtattcggtacccacgtgcattttgctgccgccgatctccgttcgatgcgaagcttcgcaactccgagttcgcgaggcgcatctgaggttcccccaatgaagttagcaaagcagtgtcccgtgcaggtcgtttttcctgtttctcacagcgttaactaggttgacagaacctggtagctgaaaaggcctcgctgctaagccctctgattattcgaggttgggggacgaaggaggaggactagaatgccggcaaatctctttccttcaggtgccactaacccaatcaactataggacaaaaaagacacggacatagtgtcacc

SEQ ID NO: 279435 - DNA, 5509 bp, Homo sapiens
  misc_feature (3360)..(3360): n is a, c, g, or t
  misc_feature (3699)..(3699): n is a, c, g, or t
cccggagcgatgggacgaggctctcccgcccgccgggctccaggatgccgcggctctcccagctccggcttgggcccctccggcggtgcccggccggtaccgtgaagccgccgctcggccttcggtgtagttgccccggacacggcgggacgccctccccgggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaattgaattcgatgactcttggtgaggtagagcaactgaatgcaaagctcctacagcaaatccaggaagtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactctagtcttctagggctaatcattttggctcatttggggactcttttttcccagaattactaaacaaattttatcacatgtgactacttaaatatactgttacagtgtcattttattaaacattttaattcacctgtcaaaacaacagattaactccttagtgtaaactactagagataatttttaagagggaaatggaattcatatcacctcttatttattatgagcaatattttaatataaaaattttatatgtgaaaatgctattttaggtactttgccattctctttataaatgtgtatttgagtggttctgtatatttatttacattatcatgtgtgaatatgttcacccatatttcaggtcactgcattttattctcttaatacaatgttttcacaacggttaccttgctttccaaagataaatatattttggattagaaatctgagttgttttaatttctaatacctcttataaaagaagaattaataactttttaaagcagtattcaggtaaatacaatacattattttgttttctaacaaaagcagttcttagttcaggaagaaaagactaatctggcttctatgtcaatttgtctccatagaaatgaaagcctcctcttgcttctttcattattagcttcacaccaatgactgtgatgcattagaatttggacagagtaagtcaagcctcacttccaattcaaatataatgtctatcttcaaattgagtgtgctgtgaaattgttctgtctttgaaaaaaaaaagtaagattattttgtgtgccactttgggtaaagtttcaagaatacttaaactgtccaaattgtattatcaccatcattgaacttagtgctcaaagaaagcattgtgaggtatttttctaaactttagactctatagagaaatataggattgttctacagaagaaaagcaaaactcctaattaaaaaaaaataaacctatgtattaagagaatgttctcgtaagttgcctatgatgcttccaaagagtttttatctaacagattgtgccaaacagctagataaattttaataatgtattacagtaaaggctataaccaatgcagaattaaaatgggctctaaattctgtttttaactcatgtttagaatgtacttatgaggtagatccttgcttgaaagtatctgctgaaaagcccagtaacgtggcagcttcatgcataaagatataaatgacatttgccttaaatttggcagcctaccctggcttgggtcagattttgttgttgaacacaagaaagtatttaagcaaagaaacacttcagtttaattgaaaacaactttttgtaatgctgacgtgttaaattggcctgagggtattaattgatatctgttgattttgtttttctttgaagtataacattactttttggagggaatttttgaaagatgctttcgatttctctcaattctttaagtcatgcaaaatgaatttaaaatccagggagtatggatgcattgccttagttttgatgagctttaaattaaatgtgtgcaatatcaaaatattcaaacttacaagctgggtaaatacatttcctgattaatatcttagtgcttaattgttcccacattttcaaatttgactttactcttttttggcgtaattcagtaagattgttaccagccagtgtgtttgcacacatttgggtttgtgtttagatgagttagggacagtcataaaagttggggatatgttgcatttgatatcaatagtagcatatttccagaatatgagccataagttgcagtcctgaatacaacagtgttatccaaagaaaggagttttctgacaaatatacatagctttgctaatgagtacggaacaagtggatgaacgtgtgcatgtgctaaggtcttaagtgggactctgatttattccatttagatatttctacttaagctctaaaaaggagaggtgctcttaaaaaaaactttgtggtgctggtactcacactactttatttggatgagttcctagtaaaaaaaactttttgttgaagtattttgcacagcagtttatccaaatgtttggtaaacttataatttagtcctatgttagttttcttaatcaaatatgcanttactgtgtatgcaaatataagtatcaggtacagagttctaacaagagaacatgaaatatcacaaatattgttttccacacttggctattctctacagttgttagtaatttttgagaatgttttgaagcatatctcatgtactactgtttaaaaagtggcaaaacagactgccagtcatccattactaaattttcagagcttatatgattaaggggagtgagataagacaaatctttttcacgttcagttttataatttgacacgttaaattgagttttaaaaattagaaaagtgtttttgaccacacaggttgttctctttaaagttcagccttatantgaagctaaaaatcaattatgttttactttgagattatcatcttatcctttgatcctcatattaatatctaaattagtcttttttaaaaggcatgcacttgagactccagtaatagatgattcaggcagcagaatagtgttttgttgtgtcgttgactatgcacaatggtggagcaaagacacattcttagtttttcaaaacacatgttcattttaccacaaagtgcccatttttatatacatttaaggattattttttcaatgtcaagttcatgttagtgatttcagaaatatagtcaaaatatatagtcaaatatatcttgacaggcatcttgagatttggtttttcattttactatatttatgactgaaaatggttttgtgttttctttatgttgtttatatattttttaccttagtgtttacactggtaaggcttgttagtccatttttgtagtttttttaaagtaagcttttagatctatttgtgttttaatgtttcccagtttgggttttgttttgttttggaagaatctgctttcattattaaattataaaatgtaaatgctctaaagtaggaatttttaaagagtaaattatttgtgtagcttattaggaggttcaggttagtgaccataaagtgggttacttgtacatgaaaatttgaaatggtaccatgtaaaattcttctattgtcaactttttctgatgtatgccagttcatttactgacaaatgttgttactaagtgcttattaagaagtgtaatacgctataaaaaagttaatactttttgttcagatgtaaggcaaagataattgatgccgtttcagtgtatgattgtatttttaacttttacgttggtgggagtaactatttgaggaaatttgtggtgagaattagtaagagataaaacccccaacagtttattcttaccaagtaaagttttgtggtcatggggcagggaagagtttatttaccagaatactagagccctcacacaaaataaaggtaacttggaggagggctataatgcttgcatctcagtattttcatttcacttcatcctttcataattgccttgattatggtgcagtctaacctattaagcaacttctggctatggtaacattgatatgaaccatattatatcaagtctccaaaacatctagtttgttaacatacactttccctgttctttttagtttgagtccacattactaatacattttaataatatttaattatttcacaattttaagtttaccaaagtaaacaaaaattcatgaagatgagtattgccctctcccaaaaaaggtttaaagattagttgaacttccctcaactacacctaaagcaaaggggaattttagtaagtgtgtgtaccttgtttctttcagacgcatctagaatgtttttctttcaccgtacctccaaaagaggcaatttagaaagtattaagtagtgacttttgttcagttccattttgtgtgtgtgtgtgtgtgtgtgtgtgtgtgtgtgaaccttgctttaaaacagtagcatatactatggtcattgaacttaatctctctggtgttagaaatttactttacaaaattgtgttaagacttttggaaaaagaaaatgaaactgctgtggtaaaaaccaagtttgtttcaaaaaagtaggcaattatttggctgttatattttctttgaaaactgcaataatttatatatttgtattgctctgcttgggaactgtatatatgcttgtctactatttttaattttacaacaataaaataagtattttgttaaaaaaaaaaa

SEQ ID NO: 279436 - DNA, 4938 bp, Homo sapiens
  misc_feature (2789)..(2789): n is a, c, g, or t
  misc_feature (3128)..(3128): n is a, c, g, or t
ccctatgaattttaacacaaagtgtactcaatgtagtagtttactaattctacttttgtcatatactggcaacctttttaacatcgactagacgtaaattaggactcctatgtccgcttatatacactatatacacagcacagtaaatgaaaatgcagacataagggacaatggtcaatgtgcctcctcataaacacactggacactttgcatccagaggctaatgtccagacccagcatccacattacagcagagaggaattgaattcgatgactcttggtgaggtagagcaactgaatgcaaagctcctacagcaaatccaggaagtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactctagtcttctagggctaatcattttggctcatttggggactcttttttcccagaattactaaacaaattttatcacatgtgactacttaaatatactgttacagtgtcattttattaaacattttaattcacctgtcaaaacaacagattaactccttagtgtaaactactagagataatttttaagagggaaatggaattcatatcacctcttatttattatgagcaatattttaatataaaaattttatatgtgaaaatgctattttaggtactttgccattctctttataaatgtgtatttgagtggttctgtatatttatttacattatcatgtgtgaatatgttcacccatatttcaggtcactgcattttattctcttaatacaatgttttcacaacggttaccttgctttccaaagataaatatattttggattagaaatctgagttgttttaatttctaatacctcttataaaagaagaattaataactttttaaagcagtattcaggtaaatacaatacattattttgttttctaacaaaagcagttcttagttcaggaagaaaagactaatctggcttctatgtcaatttgtctccatagaaatgaaagcctcctcttgcttctttcattattagcttcacaccaatgactgtgatgcattagaatttggacagagtaagtcaagcctcacttccaattcaaatataatgtctatcttcaaattgagtgtgctgtgaaattgttctgtctttgaaaaaaaaaagtaagattattttgtgtgccactttgggtaaagtttcaagaatacttaaactgtccaaattgtattatcaccatcattgaacttagtgctcaaagaaagcattgtgaggtatttttctaaactttagactctatagagaaatataggattgttctacagaagaaaagcaaaactcctaattaaaaaaaaataaacctatgtattaagagaatgttctcgtaagttgcctatgatgcttccaaagagtttttatctaacagattgtgccaaacagctagataaattttaataatgtattacagtaaaggctataaccaatgcagaattaaaatgggctctaaattctgtttttaactcatgtttagaatgtacttatgaggtagatccttgcttgaaagtatctgctgaaaagcccagtaacgtggcagcttcatgcataaagatataaatgacatttgccttaaatttggcagcctaccctggcttgggtcagattttgttgttgaacacaagaaagtatttaagcaaagaaacacttcagtttaattgaaaacaactttttgtaatgctgacgtgttaaattggcctgagggtattaattgatatctgttgattttgtttttctttgaagtataacattactttttggagggaatttttgaaagatgctttcgatttctctcaattctttaagtcatgcaaaatgaatttaaaatccagggagtatggatgcattgccttagttttgatgagctttaaattaaatgtgtgcaatatcaaaatattcaaacttacaagctgggtaaatacatttcctgattaatatcttagtgcttaattgttcccacattttcaaatttgactttactcttttttggcgtaattcagtaagattgttaccagccagtgtgtttgcacacatttgggtttgtgtttagatgagttagggacagtcataaaagttggggatatgttgcatttgatatcaatagtagcatatttccagaatatgagccataagttgcagtcctgaatacaacagtgttatccaaagaaaggagttttctgacaaatatacatagctttgctaatgagtacggaacaagtggatgaacgtgtgcatgtgctaaggtcttaagtgggactctgatttattccatttagatatttctacttaagctctaaaaaggagaggtgctcttaaaaaaaactttgtggtgctggtactcacactactttatttggatgagttcctagtaaaaaaaactttttgttgaagtattttgcacagcagtttatccaaatgtttggtaaacttataatttagtcctatgttagttttcttaatcaaatatgcanttactgtgtatgcaaatataagtatcaggtacagagttctaacaagagaacatgaaatatcacaaatattgttttccacacttggctattctctacagttgttagtaatttttgagaatgttttgaagcatatctcatgtactactgtttaaaaagtggcaaaacagactgccagtcatccattactaaattttcagagcttatatgattaaggggagtgagataagacaaatctttttcacgttcagttttataatttgacacgttaaattgagttttaaaaattagaaaagtgtttttgaccacacaggttgttctctttaaagttcagccttatantgaagctaaaaatcaattatgttttactttgagattatcatcttatcctttgatcctcatattaatatctaaattagtcttttttaaaaggcatgcacttgagactccagtaatagatgattcaggcagcagaatagtgttttgttgtgtcgttgactatgcacaatggtggagcaaagacacattcttagtttttcaaaacacatgttcattttaccacaaagtgcccatttttatatacatttaaggattattttttcaatgtcaagttcatgttagtgatttcagaaatatagtcaaaatatatagtcaaatatatcttgacaggcatcttgagatttggtttttcattttactatatttatgactgaaaatggttttgtgttttctttatgttgtttatatattttttaccttagtgtttacactggtaaggcttgttagtccatttttgtagtttttttaaagtaagcttttagatctatttgtgttttaatgtttcccagtttgggttttgttttgttttggaagaatctgctttcattattaaattataaaatgtaaatgctctaaagtaggaatttttaaagagtaaattatttgtgtagcttattaggaggttcaggttagtgaccataaagtgggttacttgtacatgaaaatttgaaatggtaccatgtaaaattcttctattgtcaactttttctgatgtatgccagttcatttactgacaaatgttgttactaagtgcttattaagaagtgtaatacgctataaaaaagttaatactttttgttcagatgtaaggcaaagataattgatgccgtttcagtgtatgattgtatttttaacttttacgttggtgggagtaactatttgaggaaatttgtggtgagaattagtaagagataaaacccccaacagtttattcttaccaagtaaagttttgtggtcatggggcagggaagagtttatttaccagaatactagagccctcacacaaaataaaggtaacttggaggagggctataatgcttgcatctcagtattttcatttcacttcatcctttcataattgccttgattatggtgcagtctaacctattaagcaacttctggctatggtaacattgatatgaaccatattatatcaagtctccaaaacatctagtttgttaacatacactttccctgttctttttagtttgagtccacattactaatacattttaataatatttaattatttcacaattttaagtttaccaaagtaaacaaaaattcatgaagatgagtattgccctctcccaaaaaaggtttaaagattagttgaacttccctcaactacacctaaagcaaaggggaattttagtaagtgtgtgtaccttgtttctttcagacgcatctagaatgtttttctttcaccgtacctccaaaagaggcaatttagaaagtattaagtagtgacttttgttcagttccattttgtgtgtgtgtgtgtgtgtgtgtgtgtgtgtgtgaaccttgctttaaaacagtagcatatactatggtcattgaacttaatctctctggtgttagaaatttactttacaaaattgtgttaagacttttggaaaaagaaaatgaaactgctgtggtaaaaaccaagtttgtttcaaaaaagtaggcaattatttggctgttatattttctttgaaaactgcaataatttatatatttgtattgctctgcttgggaactgtatatatgcttgtctactatttttaattttacaacaataaaataagtattttgttaaaaaaaaaaa

SEQ ID NO: 279437 - DNA, 4109 bp, Homo sapiens
  misc_feature (3219)..(3219): n is a, c, g, or t
  misc_feature (3558)..(3558): n is a, c, g, or t
gcggccgcctctgctgcggccggaaacaatagtggaggaacccgagccgcacggaacggcggtggtggcccgcggagccggacggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaataagtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactctagtcttctagggctaatcattttggctcatttggggactcttttttcccagaattactaaacaaattttatcacatgtgactacttaaatatactgttacagtgtcattttattaaacattttaattcacctgtcaaaacaacagattaactccttagtgtaaactactagagataatttttaagagggaaatggaattcatatcacctcttatttattatgagcaatattttaatataaaaattttatatgtgaaaatgctattttaggtactttgccattctctttataaatgtgtatttgagtggttctgtatatttatttacattatcatgtgtgaatatgttcacccatatttcaggtcactgcattttattctcttaatacaatgttttcacaacggttaccttgctttccaaagataaatatattttggattagaaatctgagttgttttaatttctaatacctcttataaaagaagaattaataactttttaaagcagtattcaggtaaatacaatacattattttgttttctaacaaaagcagttcttagttcaggaagaaaagactaatctggcttctatgtcaatttgtctccatagaaatgaaagcctcctcttgcttctttcattattagcttcacaccaatgactgtgatgcattagaatttggacagagtaagtcaagcctcacttccaattcaaatataatgtctatcttcaaattgagtgtgctgtgaaattgttctgtctttgaaaaaaaaaagtaagattattttgtgtgccactttgggtaaagtttcaagaatacttaaactgtccaaattgtattatcaccatcattgaacttagtgctcaaagaaagcattgtgaggtatttttctaaactttagactctatagagaaatataggattgttctacagaagaaaagcaaaactcctaattaaaaaaaaataaacctatgtattaagagaatgttctcgtaagttgcctatgatgcttccaaagagtttttatctaacagattgtgccaaacagctagataaattttaataatgtattacagtaaaggctataaccaatgcagaattaaaatgggctctaaattctgtttttaactcatgtttagaatgtacttatgaggtagatccttgcttgaaagtatctgctgaaaagcccagtaacgtggcagcttcatgcataaagatataaatgacatttgccttaaatttggcagcctaccctggcttgggtcagattttgttgttgaacacaagaaagtatttaagcaaagaaacacttcagtttaattgaaaacaactttttgtaatgctgacgtgttaaattggcctgagggtattaattgatatctgttgattttgtttttctttgaagtataacattactttttggagggaatttttgaaagatgctttcgatttctctcaattctttaagtcatgcaaaatgaatttaaaatccagggagtatggatgcattgccttagttttgatgagctttaaattaaatgtgtgcaatatcaaaatattcaaacttacaagctgggtaaatacatttcctgattaatatcttagtgcttaattgttcccacattttcaaatttgactttactcttttttggcgtaattcagtaagattgttaccagccagtgtgtttgcacacatttgggtttgtgtttagatgagttagggacagtcataaaagttggggatatgttgcatttgatatcaatagtagcatatttccagaatatgagccataagttgcagtcctgaatacaacagtgttatccaaagaaaggagttttctgacaaatatacatagctttgctaatgagtacggaacaagtggatgaacgtgtgcatgtgctaaggtcttaagtgggactctgatttattccatttagatatttctacttaagctctaaaaaggagaggtgctcttaaaaaaaactttgtggtgctggtactcacactactttatttggatgagttcctagtaaaaaaaactttttgttgaagtattttgcacagcagtttatccaaatgtttggtaaacttataatttagtcctatgttagttttcttaatcaaatatgcanttactgtgtatgcaaatataagtatcaggtacagagttctaacaagagaacatgaaatatcacaaatattgttttccacacttggctattctctacagttgttagtaatttttgagaatgttttgaagcatatctcatgtactactgtttaaaaagtggcaaaacagactgccagtcatccattactaaattttcagagcttatatgattaaggggagtgagataagacaaatctttttcacgttcagttttataatttgacacgttaaattgagttttaaaaattagaaaagtgtttttgaccacacaggttgttctctttaaagttcagccttatantgaagctaaaaatcaattatgttttactttgagattatcatcttatcctttgatcctcatattaatatctaaattagtcttttttaaaaggcatgcacttgagactccagtaatagatgattcaggcagcagaatagtgttttgttgtgtcgttgactatgcacaatggtggagcaaagacacattcttagtttttcaaaacacatgttcattttaccacaaagtgcccatttttatatacatttaaggattattttttcaatgtcaagttcatgttagtgatttcagaaatatagtcaaaatatatagtcaaatatatcttgacaggcatcttgagatttggtttttcattttactatatttatgactgaaaatggttttgtgttttctttaaagtgatttggttaggaaacttaaactctgagagcttccaaaattcaccatgaatggtaacttcatggttccgggaagccagagccaacagggaagtaatgtgctgcctagctcttcttgtctgataacagccagagtaatgcgctttgtggggaaca

SEQ ID NO: 279438 - DNA, 4927 bp, Homo sapiens
  misc_feature (2778)..(2778): n is a, c, g, or t
  misc_feature (3117)..(3117): n is a, c, g, or t
ctaattgaatctgtttatagattctaattgagaaaagtagctcagctacagtagcaaccaccatttttgctgtgtatctctgtagtcacttgatggagaagagccaaattccatttggctatgtaaagtatacagatgcctaggatgatcagaactgatatgctttgtagagaacagaactgtttccttggtatcaaatcagtttcattgtgacactttgcccaatgcatagatttcagttagagttcttgaaatataaatcatagcaccggctttctgcatactaaaaatgaaagtttttaaatcttttacagaagtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactctagtcttctagggctaatcattttggctcatttggggactcttttttcccagaattactaaacaaattttatcacatgtgactacttaaatatactgttacagtgtcattttattaaacattttaattcacctgtcaaaacaacagattaactccttagtgtaaactactagagataatttttaagagggaaatggaattcatatcacctcttatttattatgagcaatattttaatataaaaattttatatgtgaaaatgctattttaggtactttgccattctctttataaatgtgtatttgagtggttctgtatatttatttacattatcatgtgtgaatatgttcacccatatttcaggtcactgcattttattctcttaatacaatgttttcacaacggttaccttgctttccaaagataaatatattttggattagaaatctgagttgttttaatttctaatacctcttataaaagaagaattaataactttttaaagcagtattcaggtaaatacaatacattattttgttttctaacaaaagcagttcttagttcaggaagaaaagactaatctggcttctatgtcaatttgtctccatagaaatgaaagcctcctcttgcttctttcattattagcttcacaccaatgactgtgatgcattagaatttggacagagtaagtcaagcctcacttccaattcaaatataatgtctatcttcaaattgagtgtgctgtgaaattgttctgtctttgaaaaaaaaaagtaagattattttgtgtgccactttgggtaaagtttcaagaatacttaaactgtccaaattgtattatcaccatcattgaacttagtgctcaaagaaagcattgtgaggtatttttctaaactttagactctatagagaaatataggattgttctacagaagaaaagcaaaactcctaattaaaaaaaaataaacctatgtattaagagaatgttctcgtaagttgcctatgatgcttccaaagagtttttatctaacagattgtgccaaacagctagataaattttaataatgtattacagtaaaggctataaccaatgcagaattaaaatgggctctaaattctgtttttaactcatgtttagaatgtacttatgaggtagatccttgcttgaaagtatctgctgaaaagcccagtaacgtggcagcttcatgcataaagatataaatgacatttgccttaaatttggcagcctaccctggcttgggtcagattttgttgttgaacacaagaaagtatttaagcaaagaaacacttcagtttaattgaaaacaactttttgtaatgctgacgtgttaaattggcctgagggtattaattgatatctgttgattttgtttttctttgaagtataacattactttttggagggaatttttgaaagatgctttcgatttctctcaattctttaagtcatgcaaaatgaatttaaaatccagggagtatggatgcattgccttagttttgatgagctttaaattaaatgtgtgcaatatcaaaatattcaaacttacaagctgggtaaatacatttcctgattaatatcttagtgcttaattgttcccacattttcaaatttgactttactcttttttggcgtaattcagtaagattgttaccagccagtgtgtttgcacacatttgggtttgtgtttagatgagttagggacagtcataaaagttggggatatgttgcatttgatatcaatagtagcatatttccagaatatgagccataagttgcagtcctgaatacaacagtgttatccaaagaaaggagttttctgacaaatatacatagctttgctaatgagtacggaacaagtggatgaacgtgtgcatgtgctaaggtcttaagtgggactctgatttattccatttagatatttctacttaagctctaaaaaggagaggtgctcttaaaaaaaactttgtggtgctggtactcacactactttatttggatgagttcctagtaaaaaaaactttttgttgaagtattttgcacagcagtttatccaaatgtttggtaaacttataatttagtcctatgttagttttcttaatcaaatatgcanttactgtgtatgcaaatataagtatcaggtacagagttctaacaagagaacatgaaatatcacaaatattgttttccacacttggctattctctacagttgttagtaatttttgagaatgttttgaagcatatctcatgtactactgtttaaaaagtggcaaaacagactgccagtcatccattactaaattttcagagcttatatgattaaggggagtgagataagacaaatctttttcacgttcagttttataatttgacacgttaaattgagttttaaaaattagaaaagtgtttttgaccacacaggttgttctctttaaagttcagccttatantgaagctaaaaatcaattatgttttactttgagattatcatcttatcctttgatcctcatattaatatctaaattagtcttttttaaaaggcatgcacttgagactccagtaatagatgattcaggcagcagaatagtgttttgttgtgtcgttgactatgcacaatggtggagcaaagacacattcttagtttttcaaaacacatgttcattttaccacaaagtgcccatttttatatacatttaaggattattttttcaatgtcaagttcatgttagtgatttcagaaatatagtcaaaatatatagtcaaatatatcttgacaggcatcttgagatttggtttttcattttactatatttatgactgaaaatggttttgtgttttctttatgttgtttatatattttttaccttagtgtttacactggtaaggcttgttagtccatttttgtagtttttttaaagtaagcttttagatctatttgtgttttaatgtttcccagtttgggttttgttttgttttggaagaatctgctttcattattaaattataaaatgtaaatgctctaaagtaggaatttttaaagagtaaattatttgtgtagcttattaggaggttcaggttagtgaccataaagtgggttacttgtacatgaaaatttgaaatggtaccatgtaaaattcttctattgtcaactttttctgatgtatgccagttcatttactgacaaatgttgttactaagtgcttattaagaagtgtaatacgctataaaaaagttaatactttttgttcagatgtaaggcaaagataattgatgccgtttcagtgtatgattgtatttttaacttttacgttggtgggagtaactatttgaggaaatttgtggtgagaattagtaagagataaaacccccaacagtttattcttaccaagtaaagttttgtggtcatggggcagggaagagtttatttaccagaatactagagccctcacacaaaataaaggtaacttggaggagggctataatgcttgcatctcagtattttcatttcacttcatcctttcataattgccttgattatggtgcagtctaacctattaagcaacttctggctatggtaacattgatatgaaccatattatatcaagtctccaaaacatctagtttgttaacatacactttccctgttctttttagtttgagtccacattactaatacattttaataatatttaattatttcacaattttaagtttaccaaagtaaacaaaaattcatgaagatgagtattgccctctcccaaaaaaggtttaaagattagttgaacttccctcaactacacctaaagcaaaggggaattttagtaagtgtgtgtaccttgtttctttcagacgcatctagaatgtttttctttcaccgtacctccaaaagaggcaatttagaaagtattaagtagtgacttttgttcagttccattttgtgtgtgtgtgtgtgtgtgtgtgtgtgtgtgtgaaccttgctttaaaacagtagcatatactatggtcattgaacttaatctctctggtgttagaaatttactttacaaaattgtgttaagacttttggaaaaagaaaatgaaactgctgtggtaaaaaccaagtttgtttcaaaaaagtaggcaattatttggctgttatattttctttgaaaactgcaataatttatatatttgtattgctctgcttgggaactgtatatatgcttgtctactatttttaattttacaacaataaaataagtattttgttaaaaaaaaaaa

SEQ ID NO: 279439 - DNA, 504 bp, Homo sapiens
aagtgcaatgttggagtgcaagtatggcgatgcttgtttgatggagcttttgctttaaatgagctgaacagcatccttatttcctagaagttcccagtaaagggaactaccccaaaggcaggttcatgaaattgtgtaactttccttttctgtttcttaataggggcactatgaacgaagaggagcagtttgtaaacattgatttgaatgatgacaacatttgcagtgtttgtaaactgggaacagacaaagaaacactctccttctgccacatttgttttgagctaaatattgagggtaaggacacagtatagttttgatcttatggaatgaatttaacacagctgctttgtactgattgtaaggtaaaactaaaatgtcttcaatgattggaaattgtgctaagtatgaatagtgtagagatttgttaaagataaggtttctggaaatgaaggtgcagttaacagagttacgaatttaagagaaatctttttttttaaagac

SEQ ID NO: 279440 - DNA, 1593 bp, Homo sapiens
gcggccgcctctgctgcggccggaaacaatagtggaggaacccgagccgcacggaacggcggtggtggcccgcggagccggacggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaattgaattcgatgactcttggtgaggtagagcaactgaatgcaaagctcctacagcaaatccaggaagtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactctagtcttctagggctaatcattttggctcatttggggactcttttttcccagaattactaaacaaattttatcacatgtgactacttaaatatactgttacagtgtcattttattaaacattttaattcacctgtcaaaacaacagattaactccttagtgtaaactactagagataatttttaagagggaaatggaattcatatcacctcttatttattatgagcaatattttaatataaaaattttatatgtgaaaatgctattttaggtactttgccattctctttataaatgtgtatttgagtggttctgtatatttatttacattatcatgtgtgaatatgttcacccatatttcaggtcactgcattttattctcttaatacaatgttttcacaacggttaccttgctttccaaagataaatatattttggattag

SEQ ID NO: 279441 - DNA, 5368 bp, Homo sapiens
  misc_feature (3219)..(3219): n is a, c, g, or t
  misc_feature (3558)..(3558): n is a, c, g, or t
gcggccgcctctgctgcggccggaaacaatagtggaggaacccgagccgcacggaacggcggtggtggcccgcggagccggacggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaataagtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactctagtcttctagggctaatcattttggctcatttggggactcttttttcccagaattactaaacaaattttatcacatgtgactacttaaatatactgttacagtgtcattttattaaacattttaattcacctgtcaaaacaacagattaactccttagtgtaaactactagagataatttttaagagggaaatggaattcatatcacctcttatttattatgagcaatattttaatataaaaattttatatgtgaaaatgctattttaggtactttgccattctctttataaatgtgtatttgagtggttctgtatatttatttacattatcatgtgtgaatatgttcacccatatttcaggtcactgcattttattctcttaatacaatgttttcacaacggttaccttgctttccaaagataaatatattttggattagaaatctgagttgttttaatttctaatacctcttataaaagaagaattaataactttttaaagcagtattcaggtaaatacaatacattattttgttttctaacaaaagcagttcttagttcaggaagaaaagactaatctggcttctatgtcaatttgtctccatagaaatgaaagcctcctcttgcttctttcattattagcttcacaccaatgactgtgatgcattagaatttggacagagtaagtcaagcctcacttccaattcaaatataatgtctatcttcaaattgagtgtgctgtgaaattgttctgtctttgaaaaaaaaaagtaagattattttgtgtgccactttgggtaaagtttcaagaatacttaaactgtccaaattgtattatcaccatcattgaacttagtgctcaaagaaagcattgtgaggtatttttctaaactttagactctatagagaaatataggattgttctacagaagaaaagcaaaactcctaattaaaaaaaaataaacctatgtattaagagaatgttctcgtaagttgcctatgatgcttccaaagagtttttatctaacagattgtgccaaacagctagataaattttaataatgtattacagtaaaggctataaccaatgcagaattaaaatgggctctaaattctgtttttaactcatgtttagaatgtacttatgaggtagatccttgcttgaaagtatctgctgaaaagcccagtaacgtggcagcttcatgcataaagatataaatgacatttgccttaaatttggcagcctaccctggcttgggtcagattttgttgttgaacacaagaaagtatttaagcaaagaaacacttcagtttaattgaaaacaactttttgtaatgctgacgtgttaaattggcctgagggtattaattgatatctgttgattttgtttttctttgaagtataacattactttttggagggaatttttgaaagatgctttcgatttctctcaattctttaagtcatgcaaaatgaatttaaaatccagggagtatggatgcattgccttagttttgatgagctttaaattaaatgtgtgcaatatcaaaatattcaaacttacaagctgggtaaatacatttcctgattaatatcttagtgcttaattgttcccacattttcaaatttgactttactcttttttggcgtaattcagtaagattgttaccagccagtgtgtttgcacacatttgggtttgtgtttagatgagttagggacagtcataaaagttggggatatgttgcatttgatatcaatagtagcatatttccagaatatgagccataagttgcagtcctgaatacaacagtgttatccaaagaaaggagttttctgacaaatatacatagctttgctaatgagtacggaacaagtggatgaacgtgtgcatgtgctaaggtcttaagtgggactctgatttattccatttagatatttctacttaagctctaaaaaggagaggtgctcttaaaaaaaactttgtggtgctggtactcacactactttatttggatgagttcctagtaaaaaaaactttttgttgaagtattttgcacagcagtttatccaaatgtttggtaaacttataatttagtcctatgttagttttcttaatcaaatatgcanttactgtgtatgcaaatataagtatcaggtacagagttctaacaagagaacatgaaatatcacaaatattgttttccacacttggctattctctacagttgttagtaatttttgagaatgttttgaagcatatctcatgtactactgtttaaaaagtggcaaaacagactgccagtcatccattactaaattttcagagcttatatgattaaggggagtgagataagacaaatctttttcacgttcagttttataatttgacacgttaaattgagttttaaaaattagaaaagtgtttttgaccacacaggttgttctctttaaagttcagccttatantgaagctaaaaatcaattatgttttactttgagattatcatcttatcctttgatcctcatattaatatctaaattagtcttttttaaaaggcatgcacttgagactccagtaatagatgattcaggcagcagaatagtgttttgttgtgtcgttgactatgcacaatggtggagcaaagacacattcttagtttttcaaaacacatgttcattttaccacaaagtgcccatttttatatacatttaaggattattttttcaatgtcaagttcatgttagtgatttcagaaatatagtcaaaatatatagtcaaatatatcttgacaggcatcttgagatttggtttttcattttactatatttatgactgaaaatggttttgtgttttctttatgttgtttatatattttttaccttagtgtttacactggtaaggcttgttagtccatttttgtagtttttttaaagtaagcttttagatctatttgtgttttaatgtttcccagtttgggttttgttttgttttggaagaatctgctttcattattaaattataaaatgtaaatgctctaaagtaggaatttttaaagagtaaattatttgtgtagcttattaggaggttcaggttagtgaccataaagtgggttacttgtacatgaaaatttgaaatggtaccatgtaaaattcttctattgtcaactttttctgatgtatgccagttcatttactgacaaatgttgttactaagtgcttattaagaagtgtaatacgctataaaaaagttaatactttttgttcagatgtaaggcaaagataattgatgccgtttcagtgtatgattgtatttttaacttttacgttggtgggagtaactatttgaggaaatttgtggtgagaattagtaagagataaaacccccaacagtttattcttaccaagtaaagttttgtggtcatggggcagggaagagtttatttaccagaatactagagccctcacacaaaataaaggtaacttggaggagggctataatgcttgcatctcagtattttcatttcacttcatcctttcataattgccttgattatggtgcagtctaacctattaagcaacttctggctatggtaacattgatatgaaccatattatatcaagtctccaaaacatctagtttgttaacatacactttccctgttctttttagtttgagtccacattactaatacattttaataatatttaattatttcacaattttaagtttaccaaagtaaacaaaaattcatgaagatgagtattgccctctcccaaaaaaggtttaaagattagttgaacttccctcaactacacctaaagcaaaggggaattttagtaagtgtgtgtaccttgtttctttcagacgcatctagaatgtttttctttcaccgtacctccaaaagaggcaatttagaaagtattaagtagtgacttttgttcagttccattttgtgtgtgtgtgtgtgtgtgtgtgtgtgtgtgtgaaccttgctttaaaacagtagcatatactatggtcattgaacttaatctctctggtgttagaaatttactttacaaaattgtgttaagacttttggaaaaagaaaatgaaactgctgtggtaaaaaccaagtttgtttcaaaaaagtaggcaattatttggctgttatattttctttgaaaactgcaataatttatatatttgtattgctctgcttgggaactgtatatatgcttgtctactatttttaattttacaacaataaaataagtattttgttaaaaaaaaaaa

SEQ ID NO: 279442 - DNA, 1677 bp, Homo sapiens
aagaatcatggatgagaaaacagcaagtgagttgaagattttgtatggtcacagtgggcctgtctacggagccagcttcagtccggataggaactatctgctttcctcttcagaggacggaactgttagattgtggagccttcaaacatttacttgtttggtgggatataaaggacacaactatccagtatgggacacacaattttctccatatggatattattttgtgtcagggggccatgaccgagtagctcggctctgggctacagaccactatcagcctttaagaatatttgccggccatcttgctgatgtgaattgtaccagattccatccaaattctaattatgttgctacgggctctgcagacagaactgtgcggctctgggacgtcctgaatggtaactgtgtaaggatcttcactggacacaagggaccaattcattccttgacattttctcccaatgggagattcctggctacaggagcaacagatggcagagtgcttctttgggatattggacatggtttgatggttggagaattaaaaggccacactgatacagtctgttcacttaggtttagtagagatggtgaaattttggcatcaggttcaatggataatacagttcgattatgggatgctatcaaagcctttgaagatttagagaccgatgactttactacagccactgggcatataaatttacctgagaattcacaggagttattgttgggaacatatatgaccaaatcaacaccagttgtacaccttcattttactcgaagaaacctggttctagctgcaggagcttatagtccacaataaaccatcggtattaaagaccttttggaagctactgtttttaaaaagggagactaaaagcaaatacctcagtgattaatatttaagctacagagaatgtttttgtctatatggatctggaagtatgctgcttggaaaaatctgaacaggacagttccacgtttctatagcaaccacatttgactaatttccgttagttgaataagaggtattatgatcatggaggggacatttatggtgctttggattgtgtggaaactatgcattttctgttcaaatgctattttaatttattacattagaaaaaaagttgatttcaataattcatcctgcttcaagattcaaattcagaaatatactatcatcttgaattttagctgaagaatcctatgagcatgtatgtttctgctgtaaaaacgtagttactgtatggcactcaaaaactatgttaaatgatccactaactttttttttcttggcccatgattaatggaatgtatgtaactaggtagggttcctttcttagatctagaggaagtacagccacccactgacatctgaatttatatacctgttgagttttgagtgcacccaaacactcgataaaccaggtgaagaaatttagcttccatgttctacttcagctaaaacagctacatacaacctagtacacttgaagtcagacagacatttcagttgcttacctccagtactgagccttgctttgggaaactaaaagatttagaccaagtcactgccagtttttgcctttgttgcattttgtacagtttttatatttttgatatcttgtaaataaagacaaccagcttttccaggttcataatttattg

SEQ ID NO: 279443 - DNA, 3261 bp, Homo sapiens
agctgtgtctcttagcaactaagcccccggctcctccagaagcccctcttcgcacatgcgcaaactgcggacgggaaactgggctccctagccctggcggtttttggtgttgctgtcccagccagaatcgcgtctggccggtgggaagccgggaactccagccccctgtaggagaggagaaaggagcgagatcatgatacatggtgatggcttgcagagtcgtaaacaaaagaagacacatgggacttcaacaactttcatcattcgcggaaacaggaagaactttcctaggcccactaaaatcatccaaatttattatagatgaagaatgtcatgaaagtgtattaatcagttcaacagtaaggcttcttgaaagtttggatttaaccagtgcagtgggacaacttctcaatgaagcagttcaagcacaaaacaacacatatagaactggaatcagtactcttttgtttcttgttggtgcttggagcagtgcagttgaagaatgtcttcatcttggtgtccccatttccataatagtatcagtaatgtcagaaggcttaaacttttgtagtgaagaggtagtttctcttcatgtacctgttcacaatatatttgactgtatggacagcacaaaaacattttctcaacttgaaacatttagtgtaagtttgtgtccttttctacaggtcccttcagatactgatttgatagaggaattgcatggtctcaaagatgttgcctctcaaacactgaccatttccaacctttctgggagaacctcttaaatcatatgaattatttaaacctcagacaaaggttgaagcagataacaacacatcacgaactctgaaaaacagcctgcttgcagatacctgctgcagacagtcaatactaatccacagtaggcattttaataggacagataatactgaaggggtaagcaaaccagatggatttcaagaacatgttacagctactcacaaaacttacagatgtaatgatttggtagagttggcagtaggcttgagtcatggagatcacagcagcatgaagttagtagaagaagcagtacagctgcaatatcagaatgcttgtgtgcaacaaggcaactgtacaaaaccatttatgtttgacatttcaagaattttcacttgctgtctaccaggcttacctgaaacttcttcttgtgtttgtccaggatatatcactgttgtgtcagtatctaataatcctgtgatcaaggaattgcagaatcagcctgtgcgaatagttctcattgagggtgacctcacagagaattaccgccacctgggatttaataagtctgcaaatattaaaacagtattagatagcatgcggcttcaagaagacagctcagaagaactgtgggcaaatcacgtgttacaggtgttaatccagttcaaggtgaaccttgtcctggtacaaggaaatgtgtccgaacgcttaattgaaaaatgtataaacagtaagcggttggtaatcggctcagtgaatggcagtgtgatgcaggcttttgcagaggctgcaggagcagtacaggtggcctacattacacaagtgaatgaagattgtgtgggcgacggggtctgcgtgaccttctggagaagcagccctttggatgttgtagataggaacaacagaatcgcaatcttattaaaaacagaaggaattaatttggttacggccgtgctcactaacccagttactgcacagatgcaaatcaaagaagataggttctggacatgtgcctatcgtttgtattatgctctaaaagaggaaaaggtcttccttggaggtggtgcagttgaatttttgtgtcttagctgtcttcatattcttgcagagcaatctctgaaaaaagaaaaccatgcctgctcagggtggctgcataatacttcctcttggctggcttcatctctggcaatatacagaccaactgtgcttaaattcctggcaaatggatggcagaaatacctttcaactctcctatataacactgccaattactcatcagaatttgaagccagcacatacattcaacatcatctgcaaaatgccacagactctggctctccttcatcttacatcttgaatgaatatagtaaactaaatagtagaatttttaattcagacatttcaaataaactggagcagattccgagagtttatgacgttgttacaccaaagattgaggcgtggcgccgagcattggatttagtattgttagtacttcagacagacagtgaaataattactggacatggacacacacagataaattcacaggaattaacgggctttctatttttgtagtgttactggctaagtctttggaaaataatttttcataatatgtcatgctaataataaatatattgatagccaagtcatggtgcctaaaatgccagctattgccaagaagaaaatagttgatgtctgtcaataactgtgcatggtctgagattttaccctacttataagctaacaagttagcctgttactgtttcgtgggatgctacagaatgcataagacacctgggtcagaaacaaaggacttatcgctcacagcaaaagctgtagccagagcttcatgttggttttattcagttcctcatttttctagttcccacaggaggaacacaaagggcccatgatgaaagcctgcacacagtgggttatgttgtaagcttgggttattaactgcttttatagtaagcaaaaaaatcctggtctttgtccaaagggagttattaccccatacttgaagatagcttagtgtaaacacaagcctaggacatggactaggtaaagacaaagtccttgcattcttgacatacccagtaagtatgcagggacactcagagcccatagtggatagtctcttccaacagtctgctcctcagcctgagatgttcttggccaaacttgaattttcacatgagtatgccactctatcagctactctgattaacctgacagtcgggttgtttagtcagtaccaaatttgttcatttggtctcatatagcaattaatgcaggctattatcagacacagcagcaggatgaagccaacctgcagtattaacctcagtcctgtcccccaaggtcttgactcaatcaactctaagttccaagggaggaccaataggtctttttattaggcagccagaatgtagtgaaggacaatttattatactttatgacccaataaagggagctttgactgacgtaatgatatgt

SEQ ID NO: 279444 - DNA, 3449 bp, Homo sapiens
agctgtgtctcttagcaactaagcccccggctcctccagaagcccctcttcgcacatgcgcaaactgcggacgggaaactgggctccctagccctggcggtttttggtgttgctgtcccagccagaatcgcgtctggccggtgggaagccgggaactccagccccctgtaggagaggagaaaggagcgaggcaggagaggaaaacaagtgcaaagtgcattcttgaagcactctgtcaaatcacttttcatgcttcattgagtagaaacatggcacattttccaaagccatcagcctgtcttgttcatattatatcccagacagacacgcaagtattgtaatcattgataaaaatctcattaggcttctggaaaatagatcatgatacatggtgatggcttgcagagtcgtaaacaaaagaagacacatgggacttcaacaactttcatcattcgcggaaacaggaagaactttcctaggcccactaaaatcatccaaatttattatagatgaagaatgtcatgaaagtgtattaatcagttcaacagtaaggcttcttgaaagtttggatttaaccagtgcagtgggacaacttctcaatgaagcagttcaagcacaaaacaacacatatagaactggaatcagtactcttttgtttcttgttggtgcttggagcagtgcagttgaagaatgtcttcatcttggtgtccccatttccataatagtatcagtaatgtcagaaggcttaaacttttgtagtgaagaggtagtttctcttcatgtacctgttcacaatatatttgactgtatggacagcacaaaaacattttctcaacttgaaacatttagtgtaagtttgtgtccttttctacaggtcccttcagatactgatttgatagaggaattgcatggtctcaaagatgttgcctctcaaacactgaccatttccaacctttctgggagaacctcttaaatcatatgaattatttaaacctcagacaaaggttgaagcagataacaacacatcacgaactctgaaaaacagcctgcttgcagatacctgctgcagacagtcaatactaatccacagtaggcattttaataggacagataatactgaaggggtaagcaaaccagatggatttcaagaacatgttacagctactcacaaaacttacagatgtaatgatttggtagagttggcagtaggcttgagtcatggagatcacagcagcatgaagttagtagaagaagcagtacagctgcaatatcagaatgcttgtgtgcaacaaggcaactgtacaaaaccatttatgtttgacatttcaagaattttcacttgctgtctaccaggcttacctgaaacttcttcttgtgtttgtccaggatatatcactgttgtgtcagtatctaataatcctgtgatcaaggaattgcagaatcagcctgtgcgaatagttctcattgagggtgacctcacagagaattaccgccacctgggatttaataagtctgcaaatattaaaacagtattagatagcatgcggcttcaagaagacagctcagaagaactgtgggcaaatcacgtgttacaggtgttaatccagttcaaggtgaaccttgtcctggtacaaggaaatgtgtccgaacgcttaattgaaaaatgtataaacagtaagcggttggtaatcggctcagtgaatggcagtgtgatgcaggcttttgcagaggctgcaggagcagtacaggtggcctacattacacaagtgaatgaagattgtgtgggcgacggggtctgcgtgaccttctggagaagcagccctttggatgttgtagataggaacaacagaatcgcaatcttattaaaaacagaaggaattaatttggttacggccgtgctcactaacccagttactgcacagatgcaaatcaaagaagataggttctggacatgtgcctatcgtttgtattatgctctaaaagaggaaaaggtcttccttggaggtggtgcagttgaatttttgtgtcttagctgtcttcatattcttgcagagcaatctctgaaaaaagaaaaccatgcctgctcagggtggctgcataatacttcctcttggctggcttcatctctggcaatatacagaccaactgtgcttaaattcctggcaaatggatggcagaaatacctttcaactctcctatataacactgccaattactcatcagaatttgaagccagcacatacattcaacatcatctgcaaaatgccacagactctggctctccttcatcttacatcttgaatgaatatagtaaactaaatagtagaatttttaattcagacatttcaaataaactggagcagattccgagagtttatgacgttgttacaccaaagattgaggcgtggcgccgagcattggatttagtattgttagtacttcagacagacagtgaaataattactggacatggacacacacagataaattcacaggaattaacgggctttctatttttgtagtgttactggctaagtctttggaaaataatttttcataatatgtcatgctaataataaatatattgatagccaagtcatggtgcctaaaatgccagctattgccaagaagaaaatagttgatgtctgtcaataactgtgcatggtctgagattttaccctacttataagctaacaagttagcctgttactgtttcgtgggatgctacagaatgcataagacacctgggtcagaaacaaaggacttatcgctcacagcaaaagctgtagccagagcttcatgttggttttattcagttcctcatttttctagttcccacaggaggaacacaaagggcccatgatgaaagcctgcacacagtgggttatgttgtaagcttgggttattaactgcttttatagtaagcaaaaaaatcctggtctttgtccaaagggagttattaccccatacttgaagatagcttagtgtaaacacaagcctaggacatggactaggtaaagacaaagtccttgcattcttgacatacccagtaagtatgcagggacactcagagcccatagtggatagtctcttccaacagtctgctcctcagcctgagatgttcttggccaaacttgaattttcacatgagtatgccactctatcagctactctgattaacctgacagtcgggttgtttagtcagtaccaaatttgttcatttggtctcatatagcaattaatgcaggctattatcagacacagcagcaggatgaagccaacctgcagtattaacctcagtcctgtcccccaaggtcttgactcaatcaactctaagttccaagggaggaccaataggtctttttattaggcagccagaatgtagtgaaggacaatttattatactttatgacccaataaagggagctttgactgacgtaatgatatgt

SEQ ID NO: 279445 - DNA, 411 bp, Homo sapiens
ttatttagctcttccttaagaggatcgatcattgtatttccagttttagagcttctcaacattctcttaaaatgagtcagaactatctttcaggctcacttaaaatgttaccatggggagttttatgggaagaaaggctaagagaaggtcaaattagcaaatataatactaaattttccaggatttcagatacgatcctgcttggtcgtgtcctatttttggttagatgtgagaaagataagtgtcttcttttcagccattagtacccatataagaatgagaaaatattttcttaatgagtcacttcctgttttaagagattatgtaattgtcctgtacttctggttttggtcagttttgtttcattcatcagtagatgttgtacgtatatctgttgtatgagagaatcat

SEQ ID NO: 279446 - DNA, 379 bp, Homo sapiens
  misc_feature (213)..(213): n is a, c, g, or t
ggtgaaattctaggaatagtcagttacctgggctagcgatacaggagctcggaatatctagcatccccaggtccaaaggcatcaagcaaggaagtagttatcagaatccattaggagagccctatagagcaggatgccttcaaagaactcatgatttttcataaaaggacacatagattgaggcaatcataagacagagctaaccagggtttnaaaagacaccttgatctcactcaattctctccctctcatctctgccgggaatttctgttggccaaatccaggtggaagcagaggacatgggggcctactgatgttcattcacatcagccatctgtagccaaagtaaggtgaagaaggatgaggagtacatctaggg

SEQ ID NO: 279447 - DNA, 1125 bp, Homo sapiens
aacctgtcttacagaaatactccattttatgcccatgcaaaggaaatagctgctacccagctaaaaactgtgtgtgttttattaaaaccacactaggtttgagatcctacagacaatgaagccctggctgataaacagccttctgctagtgtgaacagttcacttccaaaaaattaatactacagtcagggagatacgtcctttttatgtcaatagaagtgttatttgaagattttttctaccatctcatcagaaaccatcctcataaaagaccccaagctgtggaaggtcactcaccgagctgaagctaaaaccaattgagtgaatattcactttgccataaatgcccagagtgtctattttctctgggccgatcctgtggccatagagcagagtatgttttccatttacagccacctagagagatacagaagacagagccccccccgccaccaaaaaaaaacagttaataaattaacttattatccaaatttaaatgtttccttgcgtccaattttatacctgttcccacaggtctccacacacgtgaccaaatggtaaccgaaagcacccaaaacaccagcagtgcttccgaacttcttttgagttcctgatttgattaagcaccaggaactgtctctccccagacaaacaggcagtcataagtatatgtgcgtgtgcttgtgtgcgcctctgcatacatgtgagacatctgggttcgaaggtcgcctggaagcccaggcacaggtgccctggagattgtgaacccaggttaaagatctgcctgcgagctccccacaacactgtccctggagaccacccatgtggcagacactcaaaatctgttgtatttgctaaataaattaatatggacaagttacccaacatatttgaattcggttttcttattctgaagtaggaacagtctctacctcaacagactacagtaagatgacgagaaagtagcttctgcaggtcctcggcacgctacgaggctcctcctccctccctctcaaatgccaggtaccacgttaggttataggcagaaaacgcgagcagcatacaatatagtctctgactcagggagcttaaaatcccattgtggaggcaaaataaacacgtaaa

SEQ ID NO: 279448 - DNA, 732 bp, Homo sapiens
acacgctgcttctaaaacagctcacacctggctgctcacacagagggcccagaaacactgggtggcacgaggaagctcctccaggattcagaatgaacccagttccattggtggttaactaagaactacttgtctaagaaagtctccacacacgtgaccaaatggtaaccgaaagcacccaaaacaccagcagtgcttccgaacttcttttgagttcctgatttgattaagcaccaggaactgtctctccccagacaaacaggcagtcataagtatatgtgcgtgtgcttgtgtgcgcctctgcatacatgtgagacatctgggttcgaaggtcgcctggaagcccaggcacaggtgccctggagattgtgaacccaggttaaagatctgcctgcgagctccccacaacactgtccctggagaccacccatgtggcagacactcaaaatctgttgtatttgctaaataaattaatatggacaagttacccaacatatttgaattcggttttcttattctgaagtaggaacagtctctacctcaacagactacagtaagatgacgagaaagtagcttctgcaggtcctcggcacgctacgaggctcctcctccctccctctcaaatgccaggtaccacgttaggttataggcagaaaacgcgagcagcatacaatatagtctctgactcagggagcttaaaatcccattgtggaggcaaaataaacacgtaaa

SEQ ID NO: 279449 - DNA, 847 bp, Homo sapiens
gggggtgctgctcatcctggctcccagggattgcgccgtagccagctgtaatgggtgggactggcgctcactgctggtgcaggctgtggccatctgggaggtcctttctagaatctggaccttggctgtcctgagagtgacactcctcatctcaagtactgggggcatgaagttaggcttggcaggtggccccgtgtggggggcatgctgttcccaggagcccccagtggaggtcagagtacccactgctccttcttgattcaaccccttgcaggtgggataggagcatgccaggtgctgcgagggtttaatcgggctcttctgctggccttgaatatggtggacaggacaggacattctcattgctcaggagccactggcgctgcctttgggaatgaagttccacagccccccactcattgctttggctgtctgctgcatttgaaactgtacgagggtcaggaagaaggctgcggggatgaatggctctaccggcttgccacggatggggaactggagcagccagtggccccaagaggaggaaggaagggaggcacggcagacccaacaccagctgtgccaggctttggggggtgaacccatgaggcatcgtcacacactgacattttcatccctcctcagcagctgcttccggctccctgagacccagccatggaaggcatagaaaggcatgtgacaagaaactcatggcttttaatcctggcaggacaaggaaaaccccgtcaaagatttgcataaattttgctgctctcctgctgggggggggggggggcagttcgtcacatttaataaaattctctccctcccttctcccgactgcattatc

SEQ ID NO: 279450 - DNA, 362 bp, Homo sapiens
gctcggcatggcggcagtcactgccgtcacttagtcgccgatcaaggcttggactaagggcccacggtcactcgagtaggacttggatcggatgctgaataaaactcaccgtgaagcaagtcccactgaacgaaaagttggtcgtagcatttctcagcagctgcttccggctccctgagacccagccatggaaggcatagaaaggcatgtgacaagaaactcatggcttttaatcctggcaggacaaggaaaaccccgtcaaagatttgcataaattttgctgctctcctgctgggggggggggggggcagttcgtcacatttaataaaattctctccctcccttctcccgactgcattatc

SEQ ID NO: 279451 - DNA, 402 bp, Homo sapiens
agcgctgcttgggaaagggcaccttggactacctggtgggggcgttgtgcttcgttaccgaccgccgggacgccaacccacggtgcccacccgtgcgtcattccgctgtggatcagccctttggcggcccccctccaaagtctacaaggtcacacggatgtctgcaggcagaggtggggctgctggggccctgccagcagctgcttccggctccctgagacccagccatggaaggcatagaaaggcatgtgacaagaaactcatggcttttaatcctggcaggacaaggaaaaccccgtcaaagatttgcataaattttgctgctctcctgctgggggggggggggggcagttcgtcacatttaataaaattctctccctcccttctcccgactgcattatc

SEQ ID NO: 279452 - DNA, 378 bp, Homo sapiens
agcgctgcttgggaaagggcaccttggactacctggtgggggcgttgtgcttcgttaccgaccgccgggacgccaacccacggtgcccacccgtgcgtcattccgctgtggatcagccctttggcggcccccctccaaagtctacaaggtcacacggatgtctgcaggcagagcagctgcttccggctccctgagacccagccatggaaggcatagaaaggcatgtgacaagaaactcatggcttttaatcctggcaggacaaggaaaaccccgtcaaagatttgcataaattttgctgctctcctgctgggggggggggggggcagttcgtcacatttaataaaattctctccctcccttctcccgactgcattatc

SEQ ID NO: 279453 - DNA, 760 bp, Homo sapiens
  misc_feature (33)..(33): n is a, c, g, or t
  misc_feature (71)..(71): n is a, c, g, or t
gccaccctgccggacggtcaactaaggacgctncattaatagggcgcacctggggcagtttacaaccgcgnggtggcgttcgttactctatcgattgtcagcatcgcgactcatccgtcaacgggtcgtgcacgcggttcactagaagaccaccagcgacgtcccgcgcgcctcggaatccctgtatcggccgacccgtcgtggacagacagggctcgaggctcacacccggacagtcacggggggactcggcgtgaggcgctgtcggtctgatggtcccccatcagggagctaccccacaagcagaggagcagcgggatgggagcaggccaacgtcctgcggcctggttgagctcgcactgacaatcgcagctcaggcgctcaggactgccaggacccagaggattcacacgccagccccggctgaagcccagctcctcatcaaccggtgagccgcctgccagctcctgctccagctgctgagaggcctgaagagaccaagacagagacacagccccgcagcaccacagggaggccccagttaccccatgcggatgagtttcatggccatctctaactaaggacaggacatcgatgtcatctgtaacttccggtgcactggggcacacagctgcatctccccatgctcacctcctgcctcttgctctgcccagtgtgaggactcagcctggatcacctcctccaggacaagaacaacctaccatcatctgtccgtccaatctacccacccatccatctc

SEQ ID NO: 279454 - DNA, 420 bp, Homo sapiens
gcaggcactctcagaacacagcctgccggccccagcacccggccttgctcccagcctcttccctctgtattcagctcaggcgctcaggactgccaggacccagaggattcacacgccagccccggctgaagcccagctcctcatcaaccggtgagccgcctgccagctcctgctccagctgctgagaggcctgaagagaccaagacagagacacagccccgcagcaccacagggaggccccagttaccccatgcggatgagtttcatggccatctctaactaaggacaggacatcgatgtcatctgtaacttccggtgcactggggcacacagctgcatctccccatgctcacctcctgcctcttgctctgcccagtaagctcgccaacccccgaggactgctgggtctcaacgcggccg

SEQ ID NO: 279455 - DNA, 235 bp, Homo sapiens
ttggcccggaggcgttgatatggcccggaggcgttgaatggcactctcgtaactaaggacaggacatcgatgtcatctgtaacttccggtgcactggggcacacagctgcatctccccatgctcacctcctgcctcttgctctgcccagtgtgaggactcagcctggatcacctcctccaggacaagaacaacctaccatcatctgtccgtccaatctacccacccatccatctc

SEQ ID NO: 279456 - DNA, 1478 bp, Homo sapiens
ccagctgccggtcctggaacacccagaactggggccctgcagggtggaggccgggaggtcaggggtgggctccccgcgccggccccagcgcgccccgccgccggccccactcaccgctaaagaggaggattcggccgtctcggtgccgagcataggcggcctgcaccaccctcacttgggcgggcagcccctcccagaagcggtgcagccgtgcgggtcgcggggacaccagctgtccggagggctggaggcgccagaaccaggggcctgcaggggacaaaggggttcgcaggaaggcatgagacagcaggaggtctcctcccccagggtgtgtggctgggtggggaggggtcccatctggaaatcaagggcgcaatggatctagggtgaccagcccatcctggcccgcctgagacttttccctttttagcgctaaaagtgccagggccttgcctggtggctcagacctgtaatgccagcacattgggaggctgacaccggagaatcacctgagccaggagattgagcccagcctgggcaatatagtgagactccatctctacaaaataataaaataaattactagcaaggcgtggtggcatgtgcctgtggtcccagctaccagggaggctgaggtgggaggatcgcttgagcccagtattttgaggctgcagtgagccatgatcacaccactgcactgcggcccaggcaacaaagcaagaccctgtctcaaagaagaaaaaagttccgcttccagggtaagcccacagccccagtgggtcactggaagtgggcaggaaaccaacatatatgaggccaagtgaaatgactcacctttgaagaagaaagtttcccctcggatgttggcgatggcgtcaaaattgccctcacatcgatcagggatggggaaggatgggctggggaggaaaggagagagttgctgcaggccatcgcggtcatcctgagacaggcggtacttgtcagggtcgcccaccggaccctggtagaagggcctcataatggagttgggggctgaggagtggcccaggcccagggcgtggccaaactcatggacagccacggcaaacagctcaggcgctcaggactgccaggacccagaggattcacacgccagccccggctgaagcccagctcctcatcaaccggtgagccgcctgccagctcctgctccagctgctgagaggcctgaagagaccaagacagagacacagccccgcagcaccacagggaggccccagttaccccatgcggatgagtttcatggccatctctaactaaggacaggacatcgatgtcatctgtaacttccggtgcactggggcacacagctgcatctccccatgctcacctcctgcctcttgctctgcccagtgtgaggactcagcctggatcacctcctccaggacaagaacaacctaccatcatctgtccgtccaatctacccacccatccatctc

SEQ ID NO: 279457 - DNA, 465 bp, Homo sapiens
cagcacccggccttgctcccagcctcttccctctgtattcagctcaggcgctcaggactgccaggacccagaggattcacacgccagccccggctgaagcccagctcctcatcaaccggtgagccgcctgccagctcctgctccagctgctgagaggcctgaagagaccaagacagagacacagccccgcagcaccacagggaggccccagttaccccatgcggatgagtttcatggccatctctaactaaggtcagcactgttcagggcaggttcataggtaacgacctggtgaactgaaaagcaaatttctctcggtccctaaagccactcgctgagcgtctaagcatgaaacgtgagacctaagaggggtagcaaacacgttttcgttcacttctcaccaaacctgtctcctatgcccattttacagaggaggaaactgaggcacagagacttcaaggtaga

SEQ ID NO: 279458 - DNA, 295 bp, Homo sapiens
gaggagccaggggtttccttgtgggcttgtcatatggggtttggggcgccttccctgtgaggaaagagtcaggcaggtgtgcgtcccctggccttgctgcagaggacactggatggggcaatgatggtttcgcggcaggtccctctccccctaccatagagttgctgcaggccatcgcggtcatcctgagacaggcggtacttgtcagggtcgcccaccggaccctggtagaagggcctcataatggagttgggggctgaggagtggcccaggcccagggcgtggccaaactcat

SEQ ID NO: 279459 - DNA, 551 bp, Homo sapiens
aacgacgggggcgacgaccgacgcatggtcccagcgcgcgtgcgcccctgaaggcgggttccggtggcagcgccggggtctcagaccctgaggagactgagcccagcgccaggcgaccggtccccgccgccgccgcccctgcgcgggagatcccccctgcttagtccgcgcccgagcccccgtccgtgggaacagacaaggggcctccgcagcgcctcacaacccccgaccaggtccagcggcgggggactcggccgtggagggcgctgttcggtctggatggctccccccatcagcgggaggctacaccccccaccagcaggggcaagaggagcagcgggatgggagcaggccaacgtcctgcggcctggttgagctcgcactgacaatcgcaggtttcggacacgggggtcgctttggggggcctgggggcgcggggaccagagctcggggcggggcagtccagccagttgggccccatgggctggggggcgtccggctcggtcttgatgctgttcttggggaacgcagtagtgggcgcccttgaagag

SEQ ID NO: 279460 - DNA, 697 bp, Homo sapiens
aggcgggttccggtggcagcgccggggtctcagaccctgaggagactgagcccagcgccaggcgaccggtccccgccgccgccgcccctgcgcgggagatcccccctgcttagtccgcgcccgagcccccgtccgtgggaacagacaaggggcctccgcagcgcctcacaacccccgaccaggtccagcggcgggggactcggccgtggagggcgctgttcggtctggatggctccccccatcagcgggaggctacaccccccaccagcaggggcaagaggagcagcgggatgggagcaggccaacgtcctgcggcctggttgagctcgcactgacaatcgcagctcaggcgctcaggactgccaggacccagaggattcacacgccagccccggctgaagcccagctcctcatcaaccggtgagccgcctgccagctcctgctccagctgctgagaggcctgaagagaccaagacagagacacagccccgcagcaccacagggaggccccagttaccccatgcggatgagtttcatggccatctctaactaaggacaggacatcgatgtcatctgtaacttccggtgcactggggcacacagctgcatctccccatgctcacctcctgcctcttgctctgcccagtgctggagtgcagtggcacgatctcggctcactgcaacctctgcctccagg

SEQ ID NO: 279461 - DNA, 1555 bp, Homo sapiens
aggcgggttccggtggcagcgccggggtctcagaccctgaggagactgagcccagcgccaggcgaccggtccccgccgccgccgcccctgcgcgggagatcccccctgcttagtccgcgcccgagcccccgtccgtgggaacagacaaggggcctccgcagcgcctcacaacccccgaccaggtccagcggcgggggactcggccgtggagggcgctgttcggtctggatggctccccccatcagcgggaggctacaccccccaccagcaggggcaagaggagcagcgggatgggagcaggccaacgtcctgcggcctggttgagctcgcactgacaatcgcaggcccagtaacccgcaggtcaccgcgctccccacctgcgttgctgacggtgacatcgtcaggggaggggggcgcgccttcccagaggctcaggtcgcgagggtagccggggtccgggcgcgccgccgcctcgtcgtagcgccagtactgccggccgcggaccagcgctaaaagtgccagggccttgcctggtggctcagacctgtaatgccagcacattgggaggctgacaccggagaatcacctgagccaggagattgagcccagcctgggcaatatagtgagactccatctctacaaaataataaaataaattactagcaaggcgtggtggcatgtgcctgtggtcccagctaccagggaggctgaggtgggaggatcgcttgagcccagtattttgaggctgcagtgagccatgatcacaccactgcactgcggcccaggcaacaaagcaagaccctgtctcaaagaagaaaaaagttccgcttccagggtaagcccacagccccagtgggtcactggaagtgggcaggaaaccaacatatatgaggccaagtgaaatgactcacctttgaagaagaaagtttcccctcggatgttggcgatggcgtcaaaattgccctcacatcgatcagggatggggaaggatgggctggggaggaaaggagagagttgctgcaggccatcgcggtcatcctgagacaggcggtacttgtcagggtcgcccaccggaccctggtagaagggcctcataatggagttgggggctgaggagtggcccaggcccagggcgtggccaaactcatggacagccacggcaaacagctcaggcgctcaggactgccaggacccagaggattcacacgccagccccggctgaagcccagctcctcatcaaccggtgagccgcctgccagctcctgctccagctgctgagaggcctgaagagaccaagacagagacacagccccgcagcaccacagggaggccccagttaccccatgcggatgagtttcatggccatctctaactaaggacaggacatcgatgtcatctgtaacttccggtgcactggggcacacagctgcatctccccatgctcacctcctgcctcttgctctgcccagtgtgaggactcagcctggatcacctcctccaggacaagaacaacctaccatcatctgtccgtccaatctacccacccatccatctc

SEQ ID NO: 279462 - DNA, 414 bp, Homo sapiens
aagggaaaagaaactatctgcaaaggaagattctcatgcacagattgaaaccctctgagatatcaaccccctagcttggcccgtgcaggctttctttgcctttaagaagatgaaattgttaccaaagcaggagaagaatgtcagacactctgcatgcttgccagagagctcgctagaggacgtgcagaaggtcaaagtcctccatcaccagagcaagttcagccaccaggccccttaagcacagtgccaagagcctgtgaaaacatgaaacctttgaaaatatgggtgccaaaatataaaaacaaagaatgtatgaatagtatgaaatctttataaaacataatattgtcagtttcattcactgtcaaatttaatattcaaaatagtctcattacatttataaaacttgaaaaa

SEQ ID NO: 279463 - DNA, 508 bp, Homo sapiens
agacctctgcgtcgacgaggagacatgcatgtggctgcagccagtgtagcgagagctgttaggtaatgcgcaaagagaaagggatcgcgagggctgcagtgcgcacgggtcggatttgaaatcggtggccttgagcaggtactttgagaacatccccaagggtctagaccaggaaggctggactcgaggtggcatccagccccagatgccaggaggctacgccctcagccagccggtcagctgcatggaggccacccccaaccccatggagagcctgcggcacctgcatccccacgtgggaagaaccctgacctcagctgaccccttctaccagaacacacctcacagcagccgctgcgtggcacacagctgagccctgagcccttggtttgtcaatcctaggggacaggagccaggctactgtctgtacccccactccatcccccaggggaacacccctgcccagctactttcctaatgaaataaagagcattgaagcagaaaaaaa

SEQ ID NO: 279464 - DNA, 1545 bp, Homo sapiens
acacattgtttctcctgcttggcctcctccaggagggctggcttctctgcagagctctgcttcctgcagcctctccccgacctcagagcctctgcagaggaaaggccccctggggccctgccccacagcatcatgatggggaaactccccctgggggtcgtctccccttatgtgaagatgagttcggggggctacacggaccccctgaaattctacgccaccagctactgcacagcctacggtcgggaggatttcaagccccgtgtgggcagtcacgtaggcaccggctacaaatcaaatttccagcccgtggtctcatgccaagccagtctggaggccttagacaacccggccaggggggaacaagcccaggaccatttccagtctgtggccagccagagctaccgccccctggaggtgcctgacggcaagcatcccctgccctggagcatgcgccagaccagctcaggctatgggcgggagaagcccagtgcgggtccccccaccaaggaggtccggaaggtccatttcgacacccaggagcacgggcctcaggccatcacggggctggagcccagggaagtgcctctgctccaccagcagcagggccaggacccgctggagcgggagaacttccgacatggcccacgcttcatgacgtcggagtacaattccaagtatctcagggaccctctagaccagccagatttcttgcagaagaaatcgatcggcgcaaaggaggggagtggcttcaccaaacagtcccaccagagccccattgtcttccaaccgccctcacagggcctccctggggaccctgccctcctcccaggccagagtgtcaccaagtcagacttcctccccaagactcacctacatggagatgagttcctacctgtgttggccagaggctccaagcgggaaacagccttcagccgagggaatgaaaggattctgaaccccagagtgccccctccctgcccagaacccagcagcgtgagtcaccagcagtttcagccacttcatcggatgcaacagacaaacgttgccctgcttggccgggagactgtggggaaaaaggagcccacagggttcagccttaacaaccccatgtatgtccggagcccctgtgatcctgacagggatcagcgatacctgaccacctacaaccaagggtactttgagaacatccccaagggtctagaccaggaaggctggactcgaggtggcatccagccccagatgccaggaggctacgccctcagccagccggtcagctgcatggaggccacccccaaccccatggagagcctgcggcacctgcatccccacgtgggaagaaccctgacctcagctgaccccttctaccagaacacacctcacagcagccgctgcgtggcacacagctgagccctgagcccttggtttgtcaatcctaggggacaggagccaggctactgtctgtacccccactccatcccccaggggaacacccctgcccagctactttcctaatgaaataaagagcattgaagcagaaaaaaa

SEQ ID NO: 279465 - DNA, 1458 bp, Homo sapiens
  misc_feature (1453)..(1453): n is a, c, g, or t
  misc_feature (1458)..(1458): n is a, c, g, or t
acacattgtttctcctgcttggcctcctccaggagggctggcttctctgcagagctctgcttcctgcagcctctccccgacctcagagcctctgcagaggaaaggccccctggggccctgccccacagcatcatgatggggaaactccccctgggggtcgtctccccttatgtgaagatgagttcggggggctacacggaccccctgaaattctacgccaccagctactgcacagcctacggtcgggaggatttcaagccccgtgtgggcagtcacgtaggcaccggctacaaatcaaatttccagcccgtggtctcatgccaagccagtctggaggccttagacaacccggccaggggggaacaagcccaggaccatttccagtctgtggccagccagagctaccgccccctggaggtgcctgacggcaagcatcccctgccctggagcatgcgccagaccagctcaggctatgggcgggagaagcccagtgcgggtccccccaccaaggaggtccggaaggtccatttcgacacccaggagcacgggcctcaggccatcacggggctggagcccagggaagtgcctctgctccaccagcagcagggccaggacccgctggagcgggagaacttccgacatggcccacgcttcatgacgtcggagtacaattccaagtatctcagggaccctctagaccagccagatttcttgcagaagaaatcgatcggcgcaaaggaggggagtggcttcaccaaacagtcccaccagagccccattgtcttccaaccgccctcacagggcctccctggggaccctgccctcctcccaggccagagtgtcaccaagtcagacttcctccccaagactcacctacatggagatgagttcctacctgtgttggccagaggctccaagcgggaaacagccttcagccgagggaatgaaaggattctgaaccccagagtgccccctccctgcccagaacccagcagcgtgagtcaccagcagtttcagccacttcatcggatgcaacagacaaacgttgccctgcttggccgggagactgtggggaaaaaggagcccacagggttcagccttaacaaccccatgtatgtccggagcccctgtgatcctgacagggatcagcgatacctgaccacctacaaccaagggtactttgagaacatccccaagggtctagaccaggaaggctggactcgaggtggcatccagccccagatgccaggaggctacgccctcagccagccggtcagctgcatggaggccacccccaaccccatggagagcctgcggcacctgcatccccacgtgggaagaaccctgacctcagctgaccccttctaccagaacacacctcacagcagccgctgcgtggcacacagctgagccctgagcccttggttcggcaatccccttttgagagcggggnaaacn

SEQ ID NO: 279466 - DNA, 1378 bp, Homo sapiens
acacattgtttctcctgcttggcctcctccaggagggctggcttctctgcagagctctgcttcctgcagcctctccccgacctcagagcctctgcagaggaaaggccccctggggccctgccccacagcatcatgatggggaaactccccctgggggtcgtctccccttatgtgaagatgagttcggggggctacacggaccccctgaaattctacgccaccagctactgcacagcctacggtcgggaggatttcaagccccgtgtgggcagtcacgtaggcaccggctacaaatcaaatttccagcccgtggtctcatgccaagccagtctggaggccttagacaacccggccaggggggaacaagcccaggaccatttccagtctgtggccagccagagctaccgccccctggaggtgcctgacggcaagcatcccctgccctggagcatgcgccagaccagctcaggctatgggcgggagaagcccagtgcgggtccccccaccaaggaggtccggaaggtccatttcgacacccaggagcacgggcctcaggccatcacggggctggagcccagggaagtgcctctgctccaccagcagcagggccaggacccgctggagcgggagaacttccgacatggagtacaattccaagtatctcagggaccctctagaccagccagatttcttgcagaagaaatcgatcggcgcaaaggaggggagtggcttcaccaaacagtcccaccagagccccattgtcttccaaccgccctcacagggcctccctggggaccctgtgccccctccctgcccagaacccagcagcgtgagtcaccagcagtttcagccacttcatcggatgcaacagacaaacgttgccctgcttggccgggagactgtggggaaaaaggagcccacagggttcagccttaacaaccccatgtatgtccggagcccctgtgatcctgacagggatcagcgatacctgaccacctacaaccaagggtactttgagaacatccccaagggtctagaccaggaaggctggactcgaggtggcatccagccccagatgccaggaggctacgccctcagccagccggtcagctgcatggaggccacccccaaccccatggagagcctgcggcacctgcatccccacgtgggaagaaccctgacctcagctgaccccttctaccagaacacacctcacagcagccgctgcgtggcacacagctgagccctgagcccttggtttgtcaatcctaggggacaggagccaggctactgtctgtacccccactccatcccccaggggaacacccctgcccagctactttcctaatgaaataaagagcattgaagcagaaaaaaa

SEQ ID NO: 279467 - DNA, 167 bp, Homo sapiens
ctacctgtgttggccagaggctccaagcgggaaacagccttcagccgagggaatgaaaggattctgaaccccagagtgagtggccttggcgtcttgctcagagaagggagaagacagggaggtttctgggaagaggtggcatttgggtcaggcattgaagaatgaga

SEQ ID NO: 279468 - DNA, 1380 bp, Homo sapiens
acacattgtttctcctgcttggcctcctccaggagggctggcttctctgcagagctctgcttcctgcagcctctccccgacctcagagcctctgcagaggaaaggccccctggggccctgccccacagcatcatgatggggaaactccccctgggggtcgtctccccttatgtgaagatgagttcggggggctacacggaccccctgaaattctacgccaccagctactgcacagcctacggtcgggaggatttcaagccccgtgtgggcagtcacgtaggcaccggctacaaatcaaatttccagcccgtggtctcatgccaagccagtctggaggccttagacaacccggccaggggggaacaagcccaggaccatttccagtctgtggccagccagagctaccgccccctggaggtgcctgacggcaagcatcccctgccctggagcatgcgccagaccagctcaggctatgggcgggagaagcccagtgcgggtccccccaccaaggaggtccggaaggtccatttcgacacccaggagcacgggcctcaggccatcacggggctggagcccagggaagtgcctctgctccaccagcagcagggccaggacccgctggagcgggagaacttccgacatggcccacgcttcatgacgtcggagtacaattccaagtatctcagggaccctctagaccagccagatttcttgcagaagaaatcgatcggcgcaaaggaggggagtggcttcaccaaacagtcccaccagagccccattgtcttccaaccgccctcacagggcctccctggggaccctgccctcctcccaggccagagtgtcaccaagtcagacttcctccccaagactcacctacatggagatgagttcctacctgtgttggccagaggctccaagcgggaaacagccttcagccgagggaatgaaaggattctgaaccccagagtgccccctccctgcccagaacccagcagcgtgagtcaccagcagtttcagccacttcatcggatgcaacagacaaacgttgccctgcttggccgggagactgtggggaaaaaggagcccacagggttcagccttaacaaccccatgtatgtccggagcccctgtgatcctgacagggatcagcgatacctgaccacctacaaccaaggaaccctgacctcagctgaccccttctaccagaacacacctcacagcagccgctgcgtggcacacagctgagccctgagcccttggtttgtcaatcctaggggacaggagccaggctactgtctgtacccccactccatcccccaggggaacacccctgcccagctactttcctaatgaaataaagagcattgaagcagaaaaaaa

SEQ ID NO: 279469 - DNA, 1485 bp, Homo sapiens
acacattgtttctcctgcttggcctcctccaggagggctggcttctctgcagagctctgcttcctgcagcctctccccgacctcagagcctctgcagaggaaaggccccctggggccctgccccacagcatcatgatggggaaactccccctgggggtcgtctccccttatgtgaagatgagttcggggggctacacggaccccctgaaattctacgccaccagctactgcacagcctacggtcgggaggatttcaagccccgtgtgggcagtcacgtaggcaccggctacaaatcaaatttccagcccgtggtctcatgccaagccagtctggaggccttagacaacccggccaggggggaacaagcccaggaccatttccagtctgtggccagccagagctaccgccccctggaggtgcctgacggcaagcatcccctgccctggagcatgcgccagaccagctcaggctatgggcgggagaagcccagtgcgggtccccccaccaaggaggtccggaaggtccatttcgacacccaggagcacgggcctcaggccatcacggggctggagcccagggaagtgcctctgctccaccagcagcagggccaggacccgctggagcgggagaacttccgacatggcccacgcttcatgacgtcggagtacaattccaagtatctcagggaccctctagaccagccagatttcttgcagaagaaatcgatcggcgcaaaggaggggagtggcttcaccaaacagtcccaccagagccccattgtcttccaaccgccctcacagggcctccctggggaccctggagatgagttcctacctgtgttggccagaggctccaagcgggaaacagccttcagccgagggaatgaaaggattctgaaccccagagtgccccctccctgcccagaacccagcagcgtgagtcaccagcagtttcagccacttcatcggatgcaacagacaaacgttgccctgcttggccgggagactgtggggaaaaaggagcccacagggttcagccttaacaaccccatgtatgtccggagcccctgtgatcctgacagggatcagcgatacctgaccacctacaaccaagggtactttgagaacatccccaagggtctagaccaggaaggctggactcgaggtggcatccagccccagatgccaggaggctacgccctcagccagccggtcagctgcatggaggccacccccaaccccatggagagcctgcggcacctgcatccccacgtgggaagaaccctgacctcagctgaccccttctaccagaacacacctcacagcagccgctgcgtggcacacagctgagccctgagcccttggtttgtcaatcctaggggacaggagccaggctactgtctgtacccccactccatcccccaggggaacacccctgcccagctactttcctaatgaaataaagagcattgaagcagaaaaaaa

SEQ ID NO: 279470 - DNA, 778 bp, Homo sapiens
ggcgcaaacacagctgtcggaaggtggcgagcctgaggcgaacaatggcggagctgggcgaagccgatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttcaaagagtgaaatttatttatttggaattcagaaattccaggttgtatgacatcagttactcaataagtgtgaattctccaactcttcttttaatcccattttagaatttaatatagagatctctgattggcaggaacactagaaataaatgttccatggccagtagtgcaaatgggggattgtaggttttgaaaaaccaccctaagccatattaagggggttggaagaaccatcgaagcctaaggcatagaagaaaatttggggttaagaaagatgaagaacaaaaaacagctttattgcttatacatgaccaagaaaaggaaaacatggcaaaa

SEQ ID NO: 279471 - DNA, 937 bp, Homo sapiens
ggcgcaaacacagctgtcggaaggtggcgagcctgaggcgaacaatggcggagctgggcgaagccgatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttcaaacaaaaaaaaaaacttcgagatagtctctctcgtcgccgttgggagggagccgccgccaatgttttgcgcactctgcaggggatggtcgggcggaattgctccagtttcctgatcaagaggaataggcagaccttaagattgagccaataatttgagggcccgaaattcctttccgtacaggggactgattccccggaaaaatgtggggctgtggagccggagcccgagggccagggtggccgcggggcccataaagcgggagatccgggccaatgggaaggcctggccacctccttaatgtggggggcccccatcaaaaggaattgtctcgggcacggctcagaaggattcagaacatttatcggaagaaaatgtacggccgactggcatgggagcatccggggggagggccatcttggacgcagacctgtttgtgaagaaggggcccgccccaaagatttgacccggcccagaaaagggggctccaaaaa

SEQ ID NO: 279472 - DNA, 669 bp, Homo sapiens
  misc_feature (463)..(463): n is a, c, g, or t
  misc_feature (472)..(472): n is a, c, g, or t
ggcgcaaacacagctgtcggaaggtggcgagcctgaggcgaacaatggcggagctgggcgaagccgatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttcaaaaaaaaaaaaaaattttngggccgccntgggccctggaaaatttttcaacccttcggttggggcgggcgccccagtgggttcgtgcacatggccctacacggtcccaagaaaccgggtgctgaacacgtgttggttttctcccaaataaaaagcccggggaaccgggttctaccatccgaggggttcgaggcataggtccacacgggtccaggatatatagcgg

SEQ ID NO: 279473 - DNA, 699 bp, Homo sapiens
ggcgcaaacacagctgtcggaaggtggcgagcctgaggcgaacaatggcggagctgggcgaagccgatgaagcggagttgcagcgcctggtggccgccgagcagcagaaggcgcagtttactgcacaggccacgtgcccgtagaaaagatactcatccactgtgggttttggtgtcgccgtcaccccactgcctcactggattgtgaggatcatatgcgacaatgtatttgaaaacgactagaacattatcggaggaaggtggactctgaagtagtcgctgtagactatggatgtagaacaagggtttggagcccttcggacatggttctaacgcggcctgacttcttgctggctacatgaccttggactacataatcacgcctcttaaatgggaggtgatgacagctatccttgaggaccttagagagaactgatttcttagtacccagcctcacaaatagtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggctatcaacccattgtcagatcagcatcaggctgttatcaagtctgttggtgctaaaaagtaaaagatgaaatgttc

SEQ ID NO: 279474 - DNA, 443 bp, Homo sapiens
ggcgcaaacacagctgtcggaaggtggcgagcctgaggcgaacaatggcggagctgggcgaagccgatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttc

SEQ ID NO: 279475 - DNA, 1018 bp, Homo sapiens
  misc_feature (458)..(458): n is a, c, g, or t
  misc_feature (1018)..(1018): n is a, c, g, or t
ggcgcaaacacagctgtcggaaggtggcgagcctgaggcgaacaatggcggagctgggcgaagccgatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttcaaaaaaaaaaaaaanaaaaaaaaaaaaaaaaaaaaagaacagaaaaaaaaaaaaaaaaaaaaaaaaaaaacaaaagagggggggggcccagaaggacccagggaggccaaaaagaggaacacagataaaagaaaagggcccccaaaggcggcaaaaaacaaacacagaggcgcaaagaaaacgggagagcaggaaaacgaaagggaactgagagagacaacaaaagcgggggggcgacaaaagggcaaacacccaaaaaaaaaacaccagggaaacacacgcaaagaggataaggggacaacacacaaaaacgggcagaaagaagcccagagaaaagagaaatatcatgggagagcaaaaagcaacagcacacaaaagagcagacgaacgagaagaaaaagagaagcaggaacacacacgaaggaaaaaaaaagaaaaaggaagcagcaagaccaaagagaaagaaagagaaacaaggcgaaagcaggacagagagagaaaggagaaccgtagaaaaaagagacaacagaagagagagcaaaaaggtagcaaacaaagaagaagtacacacgagn

SEQ ID NO: 279476 - DNA, 776 bp, Homo sapiens
ggcgcaaacacagctgtcggaaggtggcgagcctgaggcgaacaatggcggagctgggcgaagccgatgaagcggagttgcagcgcctggtggccgccgagcagcagaaggcgcagtttactgcacaggccacgtgcccgtagaaaagatactcatccactgtgggttttggtgtcgccgtcaccccactgcctcactggattgtgaggatcatatgcgacaatgtatttgaaaacgactagaacattatcggaggaaggtggactctgaagtagtcgctgtagactatggatgtagaacaagggtttggagcccttcggacatggttctaacgcggcctgacttcttgctggctacatgaccttggactacataatcacgcctcttaaatgggaggtgatgacagctatccttgaggaccttagagagaactgatttcttagtacccagcctcacaaatagtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttc

SEQ ID NO: 279477 - DNA, 1942 bp, Homo sapiens
aaatgatacagagtctccctctgttgcccagactggagtgcagtggcacagtctcggctcactgcaacctctgcctcccaggctcaagcgattctcctgcctcagcctcccgagtagctgggattacaggcacccgcaaccgcacccggctaatttttgtatttttattagagacagggtttcaccatgttggccaggttggtctcgaactcctgacctcaggtgatctgcccgcctcagcctcccaaagtgctgggattacaggtgtgagccactgcacccagccgcctttagatatttctaaaatggtgcagccactatgaaaaacagtttggcagttcctcaaaaaggtaaatgtggagttaccataggacccagcaatttcactcctaggtagtaggtttctctatgaaatcttccaagataaaaataaaaagaaaaacaaaaagaaaacttcatttgctctcctcgttcaccaaaataaaactcaaattccttagctgcctgccatacccagtcccctttcataatctagctctaacctatctctccagcctcatctccaatgtcctcctttcttcccccgcacagtgcaaacacacaatattgacattccagcctccagctactcactcttcccaaataggtccctgcttccaagtctcagcacctgtgcttcactctgctgcaataccttctcccccttcctggcttgtgagctattatttatcttgcaagacccagctccacacccttcaggcaagcttcatcactcttcactgtgctgctagagtaggccctcccttaaggctccaaagtcatcacttatatagtgtttgtcattaggcaaaagcctgttccactttcaccagcctgggaattccttaaggccatggaaaccctggggcctggcatatagtaggtgctcaagaatcatctgcagaagacaaggcttatacctgaaagacaggtacaaacataggcttaataggctctctagaaattatactgattgataccacaaactaatttgggggccagatataaagaaaccatcaatgagaatggtttccttcgtgtcaatgtaatagtgtattatgtgttttagggatacataaacaggaaccaaagcacactacttattatgacaaggcgcttataatgatttgcatttctctgcaaaactctttaggcatataattttgttaatttgtgacaaacctcaaaaacacacttaccaccaataccttgattgcaatatatactttcaaagcacacagaaatcaagttcctttcaaaggtttccaaaagagtctgaagtgcgttgttttgtttggtttgttttaaatttgggaatttaaatgcagatcataatttataatttaacccagacttaagggaagaataatttcacaaggatgttcaagaacctgacctagccttcttttgaatgttggcactgacaatgcgtgaccttgagaagtctgtttaatctgagactgtttcatcctcagtcacatgggaataaggagagtttgttgagaggcttttaaaaagcaaaaataaataaataaataataaaaagcaaaaactttgaaaacatggagtctcttttttctcccctgagatacatcatttgaaaaaggtggggtttcaccatcttggccaggctggtcttgaactcctgaccttgtgatccaccccactcggcctccccaagtgctgggattacaggcgtgagccaccgcgcccggccctgtcatgtctttcttatccagccctctctgctcccaccacagtaccctcggttcagcttgcacttgccaccccactggtctttagctcctctgcctcccatttgcctaccctcaaatccagtcatctctcccaaacccaaataagattaaattaattccctcctccaatcttttcatgaatatgt

SEQ ID NO: 279478 - DNA, 486 bp, Homo sapiens
ttaaatgatacagagtctccctctgttgcccagactggagtgcagtggcacagtctcggctcactgcaacctctgcctcccaggctcaagcgattctcctgcctcagcctcccgagtagctgggattacaggcacccgcaaccgcacccggctaatttttgtatttttattagagacagggtttcaccatgttggccaggttggtctcgaactcctgacctcaggtgatctgcccgcctcagcctcccaaagtgctgggattacaggtgtgagccactgcgcctggcctaaagcccctcctttctttagaaagccttctataggatccaggacccagtggtcttccttacctcaaaatttagagctgatggtccattctagggtgtccagccttttcagcaacaaaaatccctcatagttaattcttgcccctctatgacacatctagaagacatctgtacttaccaagtaaactatatttcacat

SEQ ID NO: 279479 - DNA, 1621 bp, Homo sapiens
ccgttgaattcaaggatgcatatttattattaaatgaaacaacagctcctgagtttgtgctgctaggcttagaggttaggccctaggggaagagatggcctcaacttgtatttgtgttttcctcttcaggctctgcagatggcatggggaggaggttgcactcagcccatgatcctggtctctcaaagacttcaacagcagaaatggagcatggtctccatgaagccagaacagtgcgtacttctcaggtagcagcctcaggtgctaaggtgctgggcctggggtggtgtgttggggaaggaattatggagagatgtgacagggatgatgataaggcagaggcatggtgatatggggctatcagaagaaaataaggtctatgattgggcttcttttgaattagaggagattgttacatggccactatcttaccaatacatctaattcaggtgtctattactactgagtcttcccctactcttcccataccctgaggatactgtctgtgggaaaaccataagtctggtattatgtgtctgcctgtatgtgtctgtgtgtttgaaggctacaccttgccgaggcctcagcagggagtgtggggaggatgagcagtacagtgcagagaatttacgtcgcatctcacgcagtctcagtggcaccgttgtctcagagagggaggaagctccggtttcttcccacagttttgtaagtagaatcagggtccatctattcagagcaccctcctccttgctaagcactttggagaatttcacttccttgcccaagttgagtgttcatcacagtagaggtcagggtacaaagtaccagtgcattgaggtgccctgaattcagcacttggaggcaagatgaggatgacttgagtcagcagtcagacagctggcaacacagtgagacccgctacctgcatttaacagatctggacatgatattgacaggagatggcagaatgttgcctcacttgatctgaccatcagatttgactatgattctgcctgcatatacatttctgagcggaccctcttatatttgatacagcagtctgccttacctttcatgagtgcagccgtgtctcttaagtcatagtcactggcagatctggcatgtgcagatagatattcatctattctctctgcttcagagagtgatcttcagtgatctcagatctttgcacaatctcttgagtgtaatctatcctactgttgcaaactatggcgcctaaattgctctagctgcagtcttattatgtgctttcagactattgcaattccagactctaaacacaaaggccagaattatctttcaaactccattttggatggtcccttatccactctagaacctacaatgcttcctatattctctggtcccctaccaacccttcagtattcagatctggtagctaaatcgttatacatttctctattagtaggagatcctgaggtttaatcacgtcttctcagtttactgggaatgccatgagagcgggtgtgtttcctcgcagtcgttcgatcgcagcacctcctcattcttcattcgcgtcgtcaaaggtgagaggtggacgaaaccctgggggcctggcctgaagagctagctgtgtgtc

SEQ ID NO: 279480 - DNA, 1391 bp, Homo sapiens
ccgttgaattcaaggatgcatatttattattaaatgaaacaacagctcctgagtttgtgctgctaggcttagaggttaggccctaggggaagagatggcctcaacttgtatttgtgttttcctcttcaggctctgcagatggcatggggaggaggttgcactcagcccatgatcctggtctctcaaagacttcaacagcagaaatggagcatggtctccatgaagccagaacagtgcgtacttctcaggtagcagcctcaggtgctaaggtgctgggcctggggtggtgtgttggggaaggaattatggagagatgtgacagggatgatgataaggcagaggcatggtgatatggggctatcagaagaaaataaggtctatgattgggcttcttttgaattagaggagattgttacatggccactatcttaccaatacatctaattcaggtgtctattactactgagtcttcccctactcttcccataccctgaggatactgtctgtgggaaaaccataagtctggtattatgtgtctgcctgtatgtgtctgtgtgtttgaaggctacaccttgccgaggcctcagcagggagtgtggggaggatgagcagtacagtgcagagaatttacgtcgcatctcacgcagtctcagtggcaccgttgtctcagagagggaggaagctccggtttcttcccacagttttgtaagtagaatcagggtccatctattcagagcaccctcctccttgctaagcaaaaatacagtgcaggtgaagaagcagggagaaagtgaaggttgtaatgtgaggaaaggccctgtgtactcagcaaaaataaggacacgcagtcattattttatttacaaacattcagctggagcccagaggaatgtccattccatgtagcagttctgaaaggccgtgcgtgttgtagggtttcctggggtgagaagagtcataaagccttgagaggaatctgagaagcaaaggctgctgattgggtcagaacccactgcactaatcaaagaaagaaggaaagaaatgggatggagtattggtttgctttttcctctcacccccagtatgtgattgaatagaattcagtgtgttttcaatctaaagtgatgcatgtgtatcagcaagaagaggaaaaaagccttcttgagaattttcatatggtactagtgcagtaatgtgtaagtagaagaggcaggaaagcccaagccattagagatcaacaaacttaaataatatcagtggctaggtttgtaggtaatcatacctttggagaatttcacttccttgcccaagttgagtgttcatcacagtagaggtcaggggtacaaagtttctgatgaaaacaccttttttttttttttttttttgagaca

SEQ ID NO: 279481 - DNA, 903 bp, Homo sapiens
ggctaggttcgaggctgggtgaatcggccgagggtcaagagaaaggtcactggccatgggcaagcaacaatcctctctggagggtggggatagaccactttcctgggaagagtccactgaacattcttctcttgccttaaactctgggctgcctaatggtgaaacttctagcggaggacagcccaggttggcagagccagacatataccaagagaagctgtcccaagtgagagatgttaggtctaaggatctgggcagcagtactgactggggacttcctgccttggattcctgggtgaatatcacaaggttctgtgattctcagcttaagcatggggcacctaggccaggaatgaagtcctcccctcatgattcccatacgtgtgtaacctatccagagagaaatcacatcctttgcatccacattggaaccaagacacagagcaggagacctcagaattggagtctctgtatcaggccagtcttcaggcttctcaagctggctgttctggatgggggcagcaggataccgcctggcacccacttagccaaacaggctctgcagatggcatggggaggaggttgcactcagcccatgatcctggtctctcaaagacttcaacagcagaaatggagcatggtctccatgaagccagaacagtgcgtacttctcaggctacaccttgccgaggcctcagcagggagtgtggggaggatgagcagtacagtgcagagaatttacgtcgcatctcacgcagtctcagtggcaccgttgtctcagagagggaggaagctccggtttcttcccacagtggtgattcatcaaacgtgaggaagcctttggaaaccgggcaccgttgttccagctcctcttacctccctgtcatccatgacccttctgtg

SEQ ID NO: 279482 - DNA, 666 bp, Homo sapiens
ttctggattctcactctatcgcccagtctggaaaaatacagtgcaggtgaagaagcagggagaaagtgaaggttgtaatgtgaggaaaggccctgtgtactcagcaaaaataaggacacgcagtcattattttatttacaaacattcagctggagcccagaggaatgtccattccatgtagcagttctgaaaggccgtgcgtgttgtagggtttcctggggtgagaagagtcataaagccttgagaggaatctgagaagcaaaggctgctgattgggtcagaacccactgcactaatcaaagaaagaaggaaagaaatgggatggagtattggtttgctttttcctctcacccccagtatgtgattgaatagaattcagtgtgttttcaatctaaagtgatgcatgtgtatcagcaagaagaggaaaaaagccttcttgagaattttcatatggtactagtgcagtaatgtgtaagtagaagaggcaggaaagcccaagccattagagatcaacaaacttaaataatatcagtggctaggtttgtaggtaatcatacctttggagaatttcacttccttgcccaagttgagtgttcatcacagtagaggtcaggggtacaaagtttctgatgaaaacaccttttttttttttttttttttgagaca

SEQ ID NO: 279483 - DNA, 1502 bp, Homo sapiens
ggctaggttcgaggctgggtgaatcggccgagggtcaagagaaaggtcactggccatgggcaagcaacaatcctctctggagggtggggatagaccactttcctgggaagagtccactgaacattcttctcttgccttaaactctgggctgcctaatggtgaaacttctagcggaggacagcccaggttggcagagccagacatataccaagagaagctgtcccaagtgagagatgttaggtctaaggatctgggcagcagtactgactggggacttcctgccttggattcctgggtgaatatcacaaggttctgtgattctcagcttaagcatggggcacctaggccaggaatgaagtcctcccctcatgattcccatacgtgtgtaacctatccagagagaaatcacatcctttgcatccacattggaaccaagacacagagcaggagacctcagaattggagtctctgtatcaggccagtcttcaggcttctcaagctggctgttctggatgggggcagcaggataccgcctggcacccacttagccaaacaggctctgcagatggcatggggaggaggttgcactcagcccatgatcctggtctctcaaagacttcaacagcagaaatggagcatggtctccatgaagccagaacagtgcgtacttctcaggctacaccttgccgaggcctcagcagggagtgtggggaggatgagcagtacagtgcagagaatttacgtcgcatctcacgcagtctcagtggcaccgttgtctcagagagggaggaagctccggtttcttcccacagttttgtaagtagaatcagggtccatctattcagagcaccctcctccttgctaagcaaaaatacagtgcaggtgaagaagcagggagaaagtgaaggttgtaatgtgaggaaaggccctgtgtactcagcaaaaataaggacacgcagtcattattttatttacaaacattcagctggagcccagaggaatgtccattccatgtagcagttctgaaaggccgtgcgtgttgtagggtttcctggggtgagaagagtcataaagccttgagaggaatctgagaagcaaaggctgctgattgggtcagaacccactgcactaatcaaagaaagaaggaaagaaatgggatggagtattggtttgctttttcctctcacccccagtatgtgattgaatagaattcagtgtgttttcaatctaaagtgatgcatgtgtatcagcaagaagaggaaaaaagccttcttgagaattttcatatggtactagtgcagtaatgtgtaagtagaagaggcaggaaagcccaagccattagagatcaacaaacttaaataatatcagtggctaggtttgtaggtaatcatacctttggagaatttcacttccttgcccaagttgagtgttcatcacagtagaggtcaggggtacaaagtttctgatgaaaacaccttttttttttttttttttttgagaca

SEQ ID NO: 279484 - DNA, 426 bp, Homo sapiens
ggctcatgcctataatcccaacactttgggaggccgaggcgggtggatcacctgaagtcaggagtttgagaccaccttggccaacacggtgaaacacctgtaatcccagctactcgggaggctgaggtaggagaatcgcttgaacctgggaggcggaggttgcagtgagctgagatcatgcgattgcactccagcctgggtgacaagggtgaaactccgtctcaaaaaaaaaaaaaaaaaagactttgtcccaacttcctactaacaataagctcattttttcttaaaatctggatatgtttttctcatggagatggggtgcggtgagagacagagaaaccataattaattagccttttatatggagggaatagggtggttatatttaaagagaaccatactttctcacaggaatggcgactcttt

SEQ ID NO: 279485 - DNA, 1007 bp, Homo sapiens
cactcactgcgaaggtctgcggcttcactcctaaagtcaagcaagaccacaaacccactggaaggaagaaagtccagacgcatctgaacactggaaggaacaaacgttggacacaccatctttaagaactgtaacactcaccgtgagggtctgcagcttcagtcttgaagtcagtgagaccaagaactcactggaaggaaccaattctcgacacaatggaatatgacaaatctgaagctatacctgaggaattagctggagctggacaacagtaacgaggtgcaagtccccatggaagattcaagcctgtccagtggtgttgatgtggacaaaggctttgccattgcctttgttgttcttctgtttctgttcctaatagtgatgatttttcggtgtgccaagctggtgaagaatccctacaaggccagctccacaaccacagaaccatctctgagctgaagtataataaaacctggtagactcccccaagcaagagatttgaaatctgttatacacactttatattatttcacctccctgtttctcagccttctcactcttgcattccacagtgagatgaaacacaagccagtttgtattgttcctgttcagggaaatggctactaaagtgagataaaggttgaatttattggctagaataaggccatagattttaattcttcagtgcctaaggtccttaggatgagacagtgggccataattttatgatgtaatgtaacataatgtcatcatgcttggtaaggtccacctgaaactagaagctcacctagaggtggcagacttgaatgatccctttagttatgcaaatgtaggctcagcagaaaccaaatgtcctataagaagagtgtaaccagattgttttagtgtgtgaagttttataaaatctgctgttcttaagtgggcagaactctctggtaaaaggggactaatttgctgcgggtgaaatccttaatctctctcatcccaaatttcctcatctataaaat

SEQ ID NO: 279486 - DNA, 850 bp, Homo sapiens
  misc_feature (12)..(12): n is a, c, g, or t
  misc_feature (14)..(16): n is a, c, g, or t
  misc_feature (18)..(18): n is a, c, g, or t
aaaaaaaaaaangnnnanaaaaaaaagaaaaaaaaaaatgacaaaaaaaaaaagcctgcgcgaatatgacaaatctgaagctatacctgaggaattagctggagctggacaacagtaacgaggtgcaagtccccatggaagattcaagcctgtccagtggtgttgatgtggacaaaggctttgccattgcctttgttgttcttctgtttctgttcctaatagtgatgatttttcggtgtgccaagctggtgaagaatccctacaaggccagctccacaaccacagaaccatctctgagctgaagtataataaaacctggtagactcccccaagcaagagatttgaaatctgttatacacactttatattatttcacctccctgtttctcagccttctcactcttgcattccacagtgagatgaaacacaagccagtttgtattgttcctgttcagggaaatggctactaaagtgagataaaggttgaatttattggctagaataaggccatagattttaattcttcagtgcctaaggtccttaggatgagacagtgggccataattttatgatgtaatgtaacataatgtcatcatgcttggtaaggtccacctgaaactagaagctcacctagaggtggcagacttgaatgatccctttagttatgcaaatgtaggctcagcagaaaccaaatgtcctataagaagagtgtaaccagattgttttagtgtgtgaagttttataaaatctgctgttcttaagtgggcagaactctctggtaaaaggggactaatttgctgcgggtgaaatccttaatctctctcatcccaaatttcctcatctataaaat

SEQ ID NO: 279487 - DNA, 558 bp, Homo sapiens
ttttacacatgaagcaattgagtcccagagaggtagagtgatttttgcaaggtgtcattgcaaataaaagacaaaactggtggttctgtttgagggtgaccagtttgttggtattttcattatgagtcattcttttgcttgaaacaaaatctttgctgatccttgaacctggtgtttgacaggtgctatatcaatatttgtaaaatgaatgaatgaatgatagaattccaaatactgaaacccaaaccatgatactggttttccagaaatacttcctgctattttaatatattatcaattaagaaaaacagttattaaaactttttgaagacctggcgctcactcctgtaatcccagcactttgggagggcaggacgggcagatcccttgagttcaagaccagcctgagcaacatggcaaaaccatatctttacaaaaaattagttgggcatggtggcatgtgcctataatcccagctacttgggaggctaaggtgggataatcacctgagcccaggaagtatgaggctgcagcgagctatgattgcgccacttcaaa

SEQ ID NO: 279488 - DNA, 547 bp, Homo sapiens
aacaaaagacagccactgctgctgatacccaggcaaacagggtctcgagtggacctccagtaaactccaacagacctgcagctgaggctcctggctgttagaaggaaaactaacagaaaggacatccaccaccaaaaacccatctgtacgtcaccatcatcaaagaccaaaggtaggtttcttctgtattttatattgagcaaataatgccatacaacattgtgaaaaatctgtttatagggtgtgtttgttcataaaaatgctatatgaaattacgtagagctccagaatgtgaaaggggagtcatcagatccatgatcagcgtggggacccagccacagcactgacaggctgtgcgtgaggacaggtggcctgtgggcatcttgagtcttcagggtgccttagtgattgagaggtcatctctgcgtattctgggtgggtgtgcctgaatgtgaaaaatgacttaaaattgggaggctaaggtgggataatcacctgagcccaggaagtatgaggctgcagcgagctatgattgcgccacttcaaa

SEQ ID NO: 279489 - DNA, 632 bp, Homo sapiens
ctggcggctagggtttagtaactgtgggcgcgctgggttatctcaatttccatcaggcctcagctgaaagctcatctgccaaaacacatcagcactcatgtaaaataaaaggagtagggaggtgactttctacacaatactgtacagtgtttggcttccagtttccctcttgtgtgtaactattctagcactttaggttttctgaagcattcctttaggacttaaaggacatcattgaaatgttgctttccatagtctgcaggatccatttgaagctctcgttcttcatcatcttttgtaggtgccctatcctgccactatcatctagagaatgccagaatgagacaagaaatgttaaatggcaacactcagctcactttagagccatgctgcggatcaacaggggattcattttcatcaaagaatcggcctgtgaagtaggtagaggattaattcaagagtaaagagagaagaaaagaaggaatctatacggaaggcagaccagaaagtaaacaagtgaaagctggcaacttttggggtactggatataaaaggatacattttgtgaaggttatccaagacaaaagtatataagagggaagactctgaaaatatgtaatttttattaagaa

SEQ ID NO: 279490 - DNA, 567 bp, Homo sapiens
ttgtgttatatataatgattccaacttgaatgtggccacagaattttaaaactgagaaagatcatttattctaattcagcagtcttcatacagatgaagaaattgtggcccagagagtttaagtgacttgaaaagcaatacacagactatctcttgattctagactaatgtttttttctttttttctttctttttttgagacagagtctcgttctgctacctaggctggagtgcaatgtttgtaggtgccctatcctgccactatcatctagagaatgccagaatgagacaagaaatgttaaatggcaacactcagctcacgtaagattaacttgcaaatagggaaatccaaaaatgtaacagccccttctctacttcactgaggacatcatcttttgtcatttccttatattccttagtatcggtgaatttattttcttgtgaaaggaatgggagggcaacatgagggtcttggggacttgaagtagaaggtggcagtaagaaccaggggaggaagaaggagaagagtacaagaaagggagagagaaggcactgaaaatcctcgtg

SEQ ID NO: 279491 - DNA, 1798 bp, Homo sapiens
caagtttaatttttaatttattagaacccagtaaatgatgattttaaaagcagagtttccatcaaattaacacttaattcagggcaaaaatacatttaaaaaacctaaatcttaaggcagaagtaaaacattataaaaacagtatgtctaatacagactgtaaaatgtcagatttttaagagattcacatagtattttatagcactaaaatattaatacagtcagaaatattatcaattggtccaagatttctgtttataaaatgtctagactgctaattgaagaaatgttgctgtataagtaatagctacaatacaaccaaccaagtgattgtttttatgacaaaagaactaaggcaggtaattgcatggtttccatttgtaaagcttttgcagtattaaaatataaagcattactaggggtattttttgattcatctccctaccctaatgcccccgaaatgtacatcacttccctttaactctattttaaaattctgtgaaaccaccatacctattcattgtaggcctgaccctataaaggcatgaattgtttaatttgatatggtagaaaaacaattttagtaaactactacatcttttcctagtcattgagcaatttcaaacagaagtcttaagaatttttgcacctcagcaagtgaacaacctgtttctttaccactataagtttgaattttgcctagaatgtgttagtacacaggggaaaacacatttcatgtttatgtgcaattaacagtagcccttctgaaaaacagggttaacaatcttaaatttccccttgtgatcaaaaccttttgtttttagggggcaggataagatttaaaagtgctttaaatcagaaaacaagaattagctagcttacacattccactgaatagtgtcaaaaaagataaatgcatttaaaataatttgtaagtctagcaaatataagcttgacgggttcttaactaacatattaagtaattacaaagattcatttttttacaaacttttaagctattttaataaaatggctatagacctcactgtacttctatttatctgtgcattaataaaaacctgttaaaattccttatttagtacttctgaaaaagtctaatcaaataagatcactaaaattaccagaaaagctttgaaatactgattgcagattcatttcaaagtagatttaacccctttcaggatctggtgtttaaatcatgaatgtcttcaccaacttcaactctgaaaatataaaaattttagccagttctggctatagttaaacagtactggtattacttgaaaaaataaaaattaaaaatatattgtcaatcatgcattccacaatttcaagaactaagatataactcataaatactgttatgtctttgcaggttatctcaatttccatcaggcctcagctgaaagctcatctgccaaaacacatcagcactcatgtaaaataaaaggagtagggaggtgactttctacacaatactgtacagtgtttggcttccagtttccctcttgtgtgtaactattctaggtatgactccttgagcgtgaaatgaggggtagatagaacagaacagctgttgggctaacaagaattagtgtgtagactgggcgcagtggctcatgcctggaattccagcactttgggaggccaatgcaggaggatcacctgaggtcaggagttcaagaccagcctggccaacatggtgaaaccctctctctctctctctctctctctctctctctctctctctctctctctctctctctctcgctctctc

SEQ ID NO: 279492 - DNA, 1015 bp, Homo sapiens
agtccttggtgcggatgatggcgtcaggcattgcgctgtagccgccgctgcccgggcccgggcagtcctcctgggggccgccgcccgcgcgcagctccagctccagctcctcctgaggccgctcctgctgcagttgccggcggaactcctccagcagctgctccacgcccgacagctgcgcgtgcagttcggacagcggcgccgcgggcggcaaggccgcacggccgcttggcagccacaggcagagcagtagcagcccgcgcagcgccccgtgacgcggcggtagccggcgctgcgagcccgcgctctcctgggcgacggaggccatggcgacgagagccaagggcagcgagccgaggcggggctgagcgcgggaggaaggcggggacgcgggcgagcgcgggccctgggcccctcctgcgcggccgcggctggctctaggccccggcctcacagcgcggcgcccccgaacccggctgctcccccgaggtcgcgggcgccggcgggaaccgcagtagcgggagacatagccggcccagccgggcaccgctccttgccctcgccggagactgcccagcgccctgcgcctctccgccccggcctgcggcgcgctgggtggcgacgagtcggcctcggcgttgatcagcaccaggtgtgtgcgaacagtggccgcggcggggtggagccttggatgaaccgttgtccacattctgttttctgagtcaaagaggaggaagatctgtccatcgaaactgagctgccaagatccactgccgtgtccttcggctttctgctcacaagacatcctggcctgcagggtgaggggttctgcccccatcaaagagagatcagctctggccttgacagatattgagcccccatcctcttccacttgcaatttcctggtcttacttgctctgccacatcctggccttgcctctagacgtcttgcggggtgagatgaccttcctatttgtatttttacatgaaaactataaatgcctctaacctacca

SEQ ID NO: 279493 - DNA, 977 bp, Homo sapiens
agtccttggtgcggatgatggcgtcaggcattgcgctgtagccgccgctgcccgggcccgggcagtcctcctgggggccgccgcccgcgcgcagctccagctccagctcctcctgaggccgctcctgctgcagttgccggcggaactcctccagcagctgctccacgcccgacagctgcgcgtgcagttcggacagcggcgccgcgggcggcaaggccgcacggccgcttggcagccacaggcagagcagtagcagcccgcgcagcgccccgtgacgcggcggtagccggcgctgcgagcccgcgctctcctgggcgacggaggccatggcgacgagagccaagggcagcgagccgaggcggggctgagcgcgggaggaaggcggggacgcgggcgagcgcgggccctgggcccctcctgcgcggccgcggctggctctaggccccggcctcacagcgcggcgcccccgaacccggctgctcccccgaggtcgcgggcgccggcgggaaccgcagtagcgggagacatagccggcccagccgggcaccgctccttgccctcgccggagactgcccagcgccctgcgcctctccgccccggcctgcggcgcgctgggtggcgacgagtcggcctcggcgttgatcagcaccaggatgaaccgttgtccacattctgttttctgagtcaaagaggaggaagatctgtccatcgaaactgagctgccaagatccactgccgtgtccttcggctttctgctcacaagacatcctggcctgcagggtgaggggttctgcccccatcaaagagagatcagctctggccttgacagatattgagcccccatcctcttccacttgcaatttcctggtcttacttgctctgccacatcctggccttgcctctagacgtcttgcggggtgagatgaccttcctatttgtatttttacatgaaaactataaatgcctctaacctacca

SEQ ID NO: 279494 - DNA, 494 bp, Homo sapiens
gacaatgattttatagtgaagttgaagcaaagagagtgaccacctgtgagacaaagatgcaggttccctctgtgtgccgggcagtatgccagttaattcaagtgcatgtcagacccagagggtgacatcctgtgactcagatgctagggcccttatgatgcctggtaaggatgaaccgttgtccacattctgttttctgagtcaaagaggaggaagatctgtccatcgaaactgagctgccaagatccactgccgtgtccttcggctttctgctcacaagacatcctggcctgcagggtgaggggttctgcccccatcaaagagagatcagctctggccttgacagatattgagcccccatcctcttccacttgcaatttcctggtcttacttgctctgccacatcctggccttgcctctagacgtcttgcggggtgagatgaccttcctatttgtatttttacatgaaaactataaatgcctctaacctacca

SEQ ID NO: 279495 - DNA, 1730 bp, Homo sapiens
agtccttggtgcggatgatggcgtcaggcattgcgctgtagccgccgctgcccgggcccgggcagtcctcctgggggccgccgcccgcgcgcagctccagctccagctcctcctgaggccgctcctgctgcagttgccggcggaactcctccagcagctgctccacgcccgacagctgcgcgtgcagttcggacagcggcgccgcgggcggcaaggccgcacggccgcttggcagccacaggcagagcagtagcagcccgcgcagcgccccgtgacgcggcggtagccggcgctgcgagcccgcgctctcctgggcgacggaggccatggcgacgagagccaagggcagcgagccgaggcggggctgagcgcgggaggaaggcggggacgcgggcgagcgcgggccctgggcccctcctgcgcggccgcggctggctctaggccccggcctcacagcgcggcgcccccgaacccggctgctcccccgaggtcgcgggcgccggcgggaaccgcagtagcgggagacatagccggcccagccgggcaccgctccttgccctcgccggagactgcccagcgccctgcgcctctccgccccggcctgcggcgcgctgggtggcgacgagtcggcctcggcgttgatcagcaccaggtgtgtgcgaacagtggccgcggcggggtggagccttggtgagccccgcccccccgcgcggccccgcccccgcgcgtctcgcgccggctcctccagggctgggagagcaggccccggggagggcagcctcagaacaactttgctcccgcgccgctgcccagctagggcagggttcatgtctgggcccagcaggctttagcaaccaaccacacctgcccagggcgcctgcccacaggggcttggcattcgggggaatgggggcagtgggaagggagggcctgtcttcaaatcctcgtgacccccgggactactccagagagggggcacgcgcacctaggaccaccgtagcgcgtcatcagtccttcacctccagcgtccctgactttccgcatcatgttcccaagatgtgcttgggtagtacaaagtggggcggggttggggtggcggagtcagggccgggaggggtggggatgggaagtactgaaagatgttcagtctgtttaaaaacacaaaaatcaagcctggtgaggtggtactcgcctgtaagtcctgaggctgagttgggaggatggcttggacccaggagttcgagactgcaatgagctgtgatcacaccactgtactccagcctgggggacagaacaagaccctgtctttaaaaataaaaacaaaacccataaatagcagtcgtcacatgcactcagatttccacaaatataacaaaaaatctgaacacagccaacatggggacctgggagtaatacagcctgtgacagagaggcctctagcggttatatcacgtaaaatctcgggagttgtgctttaaatgacataaggaataagaaaatgtccaacccagtgggggcttcaccttggcgttctagacttctgtgagcagcatctgcatcttgtttgtttctgaatcagtttctgttgattcatttttctcctgattgtggatcgcattttcttgctttttagcctgtccggaaatttttgcctggatgcgcacattgtaaatagaacactgttaagtgtctgtattttttaggattgaaagaataaataattggtggga

SEQ ID NO: 279496 - DNA, 688 bp, Homo sapiens
acgatcacagggtcccacaataggccatctgtaagccgaggagcaaggaagccagttgaagtcccaaagctgaagagcttggagtccaatgtttgagggcatggaacatccagcactggagaaagagctcctgaaatcgtttgggtaagcaattgctgattttagtcaaattccctcacctcacaaaaagtgaagtttctgaaaagtaatacagcaggcaaataaaatctgcaggagacagcagaaggaaaagcaattattctgaataatctacacataaaaaatatgattttgtttgatatttaccacccccttcaattttgaggagcgattacttccaaatttgcatggcatcttgctgaattatcttgaggaaaaaaatagggagaagctcaaattactttgatggtaggaagagaaattatcctgatgatggtgttggaagaaagaagcatgtatgattcttggcaactgctgtcctattttttctgcaggaggcatgtatgctgagttgttctttgactcatctataaagcttttagcaaattgagggaatttgaatttctaacatcaaaatgcaatgtacaaaggaggaaaaaatatgactcacccagcccccaaatttcatatttatatctctgattgaatctggttttaaaggcgaaattttaaaggaataaaaggcaaa

SEQ ID NO: 279497 - DNA, 571 bp, Homo sapiens
acgatcacagggtcccacaataggccatctgtaagccgaggagcaaggaagccagttgaagtcccaaagctgaagagcttggagtccaatgtttgagggcatggaacatccagcactggagaaagagctcctgaaatcgtttgggtaagcaattgctgattttagtcaaattccctcacctcacaaaaagtgaagtttctgaaaagtaatacagcaggcaaataaaatctgcaggagacagcagaaggaaaagcaattattctgaataatctacacataaaaaatatgattttgtttgatatttaccacccccttcaattttgaggagcgattacttccaaatgaggcatgtatgctgagttgttctttgactcatctataaaggtattgcaaaaaggcctcatatgtccgctctataattgtacagttctcctgctaatggcatgagttagtctaatacagaaatggattattaacagaacaacctagccttacatttaaatttacctttgacaattaatcataattggaaataaacatggatattttgctctttgacccctaaatctat

SEQ ID NO: 279498 - DNA, 432 bp, Homo sapiens
acgatcacagggtcccacaataggccatctgtaagccgaggagcaaggaagccagttgaagtcccaaagctgaagagcttggagtccaatgtttgagggcatggaacatccagcactggagaaagagctcctgaaatcgtttgggtaagcaattgctgattttagtcaaattccctcacctcacaaaaagtgaagtttctgaaaagtaatacagcaggcaaataaaatctgcaggagacagcagaaggaaaagcaattattctgaataatctacacataaaaaatatgattttgtttgatatttaccacccccttcaattttgaggagcgattacttccaaatactgtcacatttatccttctttgctgctgttggtgactctgctccacagagaacaatcttcccttctcatccctgttgtgaatatatat

SEQ ID NO: 279499 - DNA, 693 bp, Homo sapiens
agtcttgctctgtcgcccaggctagagtgcagtgagctgagatcatgccactgcactccagcctgggtaacagagcgagaccctatctcaaaaaaaaattattgcttaggtactaataatgacattataaatttattttaatgatatttttgaaggataaaatatatgtgtgtatataaatggatttgtatgtaaaatatactttgaggatatattatatatattataaacaatgattagtttaaatgttcaacaagttcatggaatgttcgggtatcagtttacaatatatgattcttcttcctgaccaacagtttcctgctctacgaaacgcactcttttgccttgaagcggcattggacagtggtgtcactaatggctacaatcatgcaattctagcttatgcttttgccttagctggaaaagagaagcaagtggaatctttactccaaaccctggatcaatctgccacaaaactaaataatgtcatctactgggaaagagaaaggaaacccaagacagaagaatttccatcctttattccctgggcaccttctgctcagactgagaagagttgctatgtgctgttggctgtcatttcccggaaaattcctgacctcacctatgctagtaagattgtgcagtggcttgcccaacagatgaattcccatggaggcttttcttccaaccagg

SEQ ID NO: 279500 - DNA, 462 bp, Homo sapiens
ccacagaggcaaagaatctgcatttccataccgtctcattgtcttcttcatctttctcatcctccacaaatcggatcgcactgactctgttgacagcacgctcgttccaggcttcatcagagacatcatttaccaagttctccagtgcaccacagcgaggcagattctctgcagtgacaaagaccacataagcagggaattgcgtttcatgtgatcagtaaatgctatgaactttgcggctgacaaggtttcaatgtaaagagagaaagtcaaggtgattttggaaggacccagaaggaggagttctttacctctgatggccacagcctcactgacagggctggtgtgaagctgcaggattacctgtttccaggagcacctgatgaatcaggccaagaggaaggaggtgcctgcggtgtcaaagcatttaagttgcagccaaaataaagattaaacaccatt

SEQ ID NO: 279501 - DNA, 343 bp, Homo sapiens
ccacagaggcaaagaatctgcatttccataccgtctcattgtcttcttcatctttctcatcctccacaaatcggatcgcactgactctgttgacagcacgctcgttccaggcttcatcagagacatcatttaccaagttctccagtgcaccacagcgaggcagattctctgcagtgacaaagaccacataagcagggaattgcgtttcatgtgatcagtaaatgctatgaactttgcggctgacaaggtagaatctatacggaggaccaggggtagaacaccagaaataaggggggtgttctgttgcaagtttggctttaaaacacaaacacacacaaaattc

SEQ ID NO: 279502 - DNA, 970 bp, Homo sapiens
ttactcaccaactagtcatgcgcctcggatgccgccggccacggggctcccggaggggggtccgacaccgcccggtgcccgggatccccaatctggccggtggatgaggccccatcccatgcacccgagtgcgggggacgggggggttaatattaattcaggatcccatccccacccgaggcaggacacccagtgcacgccccaactccgggacgcgggctctgaccctggaacttccgagattcccgcgacgccccctgtctctgggtccagaacttcgggggacacctcttctgcctcctccaaccccagagatggggtgtcactatgttgcccaggctggtctccaactcctggactcaagagatctgcctgcctcagcctctcaaagggctgggataacagatgtaagccactgcatctggcctccaatgagttgttatgtgaagagaacgtgattgtagaagttagaggactccaaccaggcctgaactctcaaggacagaaatgggtccaacctggcatgacatcctctaaatctttagctcctggcctctcaggtgccccctccagctacctccctcttccttctcttcattccccaagccatagctggttgggccaacctccagacattagcctctttgcaaactcctattcatccctcaaagcctcaccttcaatgctctcctccccaagaagctctctcctctacctctagaccttttccagccctcttccctctttctggcccagccctgactcctgggagtgtctgtgtgcagctttgactcccccagcctgagtgtctctcaagggctgagaccagggcccatgtttccctagagtttgtcatcttccagcatagtgtggacgcatgggggtcaggcaaagggggagtttgatgactcagtactattggtgattttgcatcacttgaaggagaccctgccttaaattcagaacttga

SEQ ID NO: 279503 - DNA, 752 bp, Homo sapiens
caccatgcctggctaatttttcttgtatttttagtagaagtggggtttcaccattttgtccaggctggtctcaaactccttacgtcaggtgatctgcctgccttggctcccccaaagtgctgggattacaggcatgaaccattgcacctggccttgattccctttttaatgcacaaatatgaagagcaatattcaccaaactctaataaaatgtaagtgctcttgcaatcctatctgtactatccttccaaattatttttaatcccagctctttctatctttgtttagacacaggtgtaatttctgcttagttgtttcatgatgtagctcagtgtctgtgtctctttcttactttgcagtgtggagtagttttctaccaggacaaagttaacaacccataaaggtctctgcttaagtaagaagtccatttctgtgaaccataacccagatatagcaacgccagactgtctcctatcaaaatttattgaagtggtagatttttggattcctgcggtcacaccttgcaaccagtctcccactcatctgccacagtttccctaaatcagattctctgaatctggaagttccaggaaaccttaggccgagtccagtgacattactcgatgcaacagcccaactgtttctccagagatgctggttcttggtgacaatgtcccttcttggaatggttatttgaggttgggcccagataagaggggctccatggctcaccggagttggccattaacgcc

SEQ ID NO: 279504 - DNA, 2306 bp, Homo sapiens
gaattcggcacgagcggcacgagcttcacctcttcaaccaggagccgagatttctgttgctctgaagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtctcgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatgtgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgctaaaaaaaaaga

SEQ ID NO: 279505 - DNA, 2501 bp, Homo sapiens
gtgtgatctcggctcactgcaacctctgtctcctgggttcaagcgatcctcctgtctcagcctcccgagtaactgggattacaggcgcccaccaccatgcccggctaatttttgtatttttgtagacagggtttcgacatgttggccaggctggtctcaaactcctgacctcaagtgatccacccgcctcagcctcccaaagtgctgggattacaggtgtgagccactgcgcccgtcctgactcatgcaacttctgcttcagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtctcgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatgtgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgctaaaaaaaaaga

SEQ ID NO: 279506 - DNA, 2221 bp, Homo sapiens
gaattcggcacgagcggcacgagcttcacctcttcaaccaggagccgagatttctgttgctctgaagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaagagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtctcgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatgtgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgctaaaaaaaaaga

SEQ ID NO: 279507 - DNA, 1208 bp, Homo sapiens
gcaataggttattgttaactctagtcaccctactatgcaataaaacattagcacttatttaatgtgaagtttttaatacaaaaattattttaagaaaataagcacaggctgggcgccgtggctcacgcctgtaatcccagcactttgggaggccgaggcgggtggatcacctgaggtcagaggttctagacgagcctaaccaacatggggaaaccccgtctctactgaaaatacaaatttagccaggggtggtggtgggcacctgtaatcccagctacttgggaggctgaggcaggagaattgcttgaatctgagaggtggaggttgcagtgaaccgagatcgtgccattgcactccagccccagtagcgtcggacatctgtcagctctttttatgacgccatccacaccctgaagcagctccatcactgacccctgcagccgatgctccagatctgagatgagctctctcagggactgggtctgctgcaccatctcagtttcagagttcgtaaggcttttcagaatgtcttcctcctccttctccaggttttgcagctcattgctctcctcccagtccaggatgtctctcagttgctcaaaatctgccaagacgttggttttgtcatactgtatttgagtcttccaggaagctttctcttctctgatgtcagcttccaactcttcagcttcctgctgcttctgcctcagcatctccagagctgcctggagcttcacttggtactcccgggcaacctcctctgtgaggaacgtgtggtgaccacggtgctcctgagaccgctcacaaagccagcaaatgaccttcccgtcctcctgacagaagagtagaagtttctctccatggcgtgcacaatgatcaactttctgcccctctgggctcaacttgacctccctgagcttctccactatgttggctacatgccgattaggccgtatgttctcaggctggtaactgatccggcacacagggcagctactctctcctttgtctagcatggacttcttgtggtttgcagtgaggcatgcttggcagaagctgtggccgcagtccaggctcaggggttgtgtcaggagttccaggcagatggggcaggtcacctcctcctttacattaaccaggattccagaagccatagtagctattccactgctcctgcctgtcctggctgctgaggttcctcttgttca

SEQ ID NO: 279508 - DNA, 265 bp, Homo sapiens
ttttttttgagatggagtctcactctgttgcccaggatagagtacagtggcgctatcttggctcactgcaaactccgcctcccaggttcaagcaattcccctccctcagcctcccaagtatgttattcacagttacactgctggtatatggagagacaggagttgaactgagatcctctagatacaaaacctctatacttaagagtataccatttatgatattttctctttaactcacaaataagggcatcgagggtaaactgac

SEQ ID NO: 279509 - DNA, 3539 bp, Homo sapiens
agatgagccttccgcaaactcctgacctgtgggtccgtccgttcaacggccaaaggctggcggaggagggatcccctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaagacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagaggggagatgaaatggccaggtgacatcctcacaggattcctcaccattcccctcaatgtagtaaggagagagataccagacatgagacagttggtcctattcaacattattgactcttttcatcattacagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctaggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcatttta

SEQ ID NO: 279510 - DNA, 2323 bp, Homo sapiens
atttgttgaatgaatcctgaccacacccaccctggcttttcttcacctcttcaaccaggagccgagatttctgttgctctgaagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtctcgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatgtgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgctaaaaaaaaaga

SEQ ID NO: 279511 - DNA, 2778 bp, Homo sapiens
ctgagtctttcggcctgggtggaggacgcggctgcttcaagtccttggctctgatccaggccacagattccagattctacaggcaggaaacttctcctcggcctcccgtgcccaggagtaccaggagaagtttcaggagtctctaaagaagctgaagaacgaggagcaggaagctgagaagctaacagcttttatcagagagaagaagacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctaggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcatttta

SEQ ID NO: 279512 - DNA, 2541 bp, Homo sapiens
gtgtgatctcggctcactgcaacctctgtctcctgggttcaagcgatcctcctgtctcagcctcccgagtaactgggattacaggcgcccaccaccatgcccggctaatttttgtatttttgtagacagggtttcgacatgttggccaggctggtctcaaactcctgacctcaagtgatccacccgcctcagcctcccaaagtgctgggattacaggtgtgagccactgcgcccgtcctgactcatgcaacttctgcttcagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctccttaatgtttccctgatgtgatactttgagagcccaggatgccagtacaataattgaaattcacaaatgtctggtatcttgtccctcgtgccccatatattatctgtggtttcggagagctcacttgtctcttatcttcagaaatgacagcacatgaaatgttgtttggagccactgtcacatcaactgtagaaaaattaacaggtcagctaagggatataatgtaactttatttgtgatatgagagaaatcttgataaagacttgagagaaaactgggaggaaccttgtttagaagttataaggaggggtaagttatgtgtgtcttggaaggagaatcataaatcttaaaacatgagcctaatagagaacataaaattctaaaagataaagataataataatgataagccgcagggtggcttatgataatgtgacttctccttaccccagtagcgtcggacatctgtcagctctgaaatgataaaaatgcacaatattgaatacaaacaaaggagtcagcactgaaattcattttctctccagattagggaaagagtaggtatgccctatggtagggcagtaaattgctgaatgatgagatgaaacagccacctagccatttcccattaaatataatcccatcagcagcagacaatatctatcctcccctatcccctctatccatatttggaaactgcaccctcttccctatttagcaccctaacaccacttgaattccataaccctgttgttgatctagctctcctcacctctaaacacttctagcattcctttcagatcaggagctcgaaacactctcctttgattttttggaaaagtttctggcttcttcaaggtcacgttctccgtcctaagaattaaaaaaaaaaaaaaaacttccaaacctttgaccttgtgtccgtggaacacccctgacttcctatcatttcaacccattgaggcacttgaactctcttcttggggatcctgagaagggagagtgcaaactcttgaccctggaggcaaacaaaatgttctcatgtttgccttcccacttactttctgcgagaacgtgggaagatcttaacctctcagaagcacagtttcttccttctaaaatgaaataattaacctctccctgtctacattcttaaactcataggacat

SEQ ID NO: 279513 - DNA, 1217 bp, Homo sapiens
gtgtgatctcggctcactgcaacctctgtctcctgggttcaagcgatcctcctgtctcagcctcccgagtaactgggattacaggcgcccaccaccatgcccggctaatttttgtatttttgtagacagggtttcgacatgttggccaggctggtctcaaactcctgacctcaagtgatccacccgcctcagcctcccaaagtgctgggattacaggtgtgagccactgcgcccgtcctgactcatgcaacttctgcttcagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggtgcgtatgggtggccacgagtggtgcttgtgagttataaagaagtgtttgtagctattagagttatttggtggtcaattggaataaaaaatctcccagagtagt

SEQ ID NO: 279514 - DNA, 1267 bp, Homo sapiens
gtgtgatctcggctcactgcaacctctgtctcctgggttcaagcgatcctcctgtctcagcctcccgagtaactgggattacaggcgcccaccaccatgcccggctaatttttgtatttttgtagacagggtttcgacatgttggccaggctggtctcaaactcctgacctcaagtgatccacccgcctcagcctcccaaagtgctgggattacaggtgtgagccactgcgcccgtcctgactcatgcaacttctgcttcagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtaagtgatgtcacagaaaggagtgagttctggaccctgaggaagccagaagctctccctacaagctgagaagtatgttccgagccccagatcgaaaagagctgcgatgtgtagagagatgtccaagctctggcatacgagacggatgttgtaccttttcctacgttgatgaccc

SEQ ID NO: 279515 - DNA, 865 bp, Homo sapiens
agctcggaccccactttccgagtagcgtcggacatctgtcagctctttttatgacgccatccacaccctgaagcagctccatcactgacccctgcagccgatgctccagatctgagatgagctctctcagggactgggtctgctgcaccatctcagtttcagagttcgtaaggcttttcagaatgtcttcctcctccttctccaggttttgcagctcattgctctcctcccagtccaggatgtctctcagttgctcaaaatctgccaagacgttggttttgtcatactgtatttgagtcttccaggaagctttctcttctctgatgtcagcttccaactcttcagcttcctgctgcttctgcctcagcatctccagagctgcctggagcttcacttggtactcccgggcaacctcctctgtgaggaacgtgtggtgaccacggtgctcctgagaccgctcacaaagccagcaaatgaccttcccgtcctcctgacagaagagtagaagtttctctccatggcgtgcacaatgatcaactttctgcccctctgggctcaacttgacctccctgagcttctccactatgttggctacatgccgattaggccgtatgttctcaggctggtaactgatccggcacacagggcagctactctctcctttgtctagcatggacttcttgtggtttgcagtgaggcatgcttggcagaagctgtggccgcagtccaggctcaggggttgtgtcaggagttccaggcagatggggcaggtcacctcctcctttacattaaccaggattccagaagccatagtagctattccactgctcctgcctgtcctggctgctgaggttcctcttgttca

SEQ ID NO: 279516 - DNA, 461 bp, Homo sapiens
caagttttcatcctaggttaggacaggcttcttttgaggttagcagaatctctgtcccattcattctatgtctgggtactgagtcaactgaaggcttgatcctgcttgacctgatttgttttcttcaaggagaagtttcaggagtctctaaagaagctgaagaacgaggagcaggaagctgagaagctaacagcttttatcagagagaagaagacatcctggaaggcaagggagactttttctgaagatgtcctggggcaggaatcatggcaggtcataggagctgagggcaaaggagtccttgtcctgtctgtcctctgatgccatgactagaagagcttccctttgcctggtcctccactatattccttccaaacagggggaggagaggaggtaaatagcaaatatatcaaaactgaacctaggagacaatcacatagcagaggaaccatggctagggg

SEQ ID NO: 279517 - DNA, 3472 bp, Homo sapiens
agatgagccttccgcaaactcctgacctgtgggtccgtccgttcaacggccaaaggctggcggaggagggatcccctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaagacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtctcgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatgtgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgctaaaaaaaaaga

SEQ ID NO: 279518 - DNA, 3217 bp, Homo sapiens
ctgagtctttcggcctgggtggaggacgcggctgcttcaagtccttggctctgatccaggccacagattccaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaagacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctaggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcatttta

SEQ ID NO: 279519 - DNA, 3177 bp, Homo sapiens
agatgagccttccgcaaactcctgacctgtgggtccgtccgttcaacggccaaaggctggcggaggagggatcccctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaagacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagaggggagatgaaatggccaggtgacatcctcacaggattcctcaccattcccctcaatgtagtaaggagagagataccagacatgagacagttggtcctattcaacattattgactcttttcatcattacagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctaggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcatttta

SEQ ID NO: 279520 - DNA, 3465 bp, Homo sapiens
agatgagccttccgcaaactcctgacctgtgggtccgtccgttcaacggccaaaggctggcggaggagggatcccctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaagacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggcataacgagacccatgtccccgttctcatctgctgatgttgtaccttttcctacagttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctaggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcatttta

SEQ ID NO: 279521 - DNA, 3557 bp, Homo sapiens
agatgagccttccgcaaactcctgacctgtgggtccgtccgttcaacggccaaaggctggcggaggagggatcccctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaagacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagaggggagatgaaatggccaggtgacatcctcacaggattcctcaccattcccctcaatgtagtaaggagagagataccagacatgagacagttggtcctattcaacattattgactcttttcatcattacagagctgacagatgtccaaagctactgggccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaagagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctccttaatgtttccctgatgtgatactttgagagcccaggatgccagtacaataattgaaattcacaaatgtctggtatcttgtccctcgtgccccatatattatctgtggtttcggagagctcacttgtctcttatcttcagaaatgacagcacatgaaatgttgtttggagccactgtcacatcaactgtagaaaaattaacaggtcagctaagggatataatgtaactttatttgtgatatgagagaaatcttgataaagacttgagagaaaactgggaggaaccttgtttagaagttataaggaggggtaagttatgtgtgtcttggaaggagaatcataaatcttaaaacatgagcctaatagagaacataaaattctaaaagataaagataataataatgataagccgcagggtggcttatgataatgtgacttctccttaccccagtagcgtcggacatctgtcagctctgaaatgataaaaatgcacaatattgaatacaaacaaaggagtcagcactgaaattcattttctctccagattagggaaagagtaggtatgccctatggtagggcagtaaattgctgaatgatgagatgaaacagccacctagccatttcccattaaatataatcccatcagcagcagacaatatctatcctcccctatcccctctatccatatttggaaactgcaccctcttccctatttagcaccctaacaccacttgaattccataaccctgttgttgatctagctctcctcacctctaaacacttctagcattcctttcagatcaggagctcgaaacactctcctttgattttttggaaaagtttctggcttcttcaaggtcacgttctccgtcctaagaattaaaaaaaaaaaaaaaacttccaaacctttgaccttgtgtccgtggaacacccctgacttcctatcatttcaacccattgaggcacttgaactctcttcttggggatcctgagaagggagagtgcaaactcttgaccctggaggcaaacaaaatgttctcatgtttgccttcccacttactttctgcgagaacgtgggaagatcttaacctctcagaagcacagtttcttccttctaaaatgaaataattaacctctccctgtctacattcttaaactcataggacat

SEQ ID NO: 279522 - DNA, 2768 bp, Homo sapiens
gtgtgatctcggctcactgcaacctctgtctcctgggttcaagcgatcctcctgtctcagcctcccgagtaactgggattacaggcgcccaccaccatgcccggctaatttttgtatttttgtagacagggtttcgacatgttggccaggctggtctcaaactcctgacctcaagtgatccacccgcctcagcctcccaaagtgctgggattacaggtgtgagccactgcgcccgtcctgactcatgcaacttctgcttcagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctccttaatgtttccctgatgtgatactttgagagcccaggatgccagtacaataattgaaattcacaaatgtctggtatcttgtccctcgtgccccatatattatctgtggtttcggagagctcacttgtctcttatcttcagaaatgacagcacatgaaatgttgtttggagccactgtcacatcaactgtagaaaaattaacaggtcagctaagggatataatgtaactttatttgtgatatgagagaaatcttgataaagacttgagagaaaactgggaggaaccttgtttagaagttataaggaggggtaagttatgtgtgtcttggaaggagaatcataaatcttaaaacatgagcctaatagagaacataaaattctaaaagataaagataataataatgataagccgcagggtggcttatgataatgtgacttctccttaccccagtagcgtcggacatctgtcagctctctaaacacttctagcattcctttcagatcaggagctcgaaacactctcctttgattttttggaaaagtttctggcttcttcaaggtcacgttctccgtcctttttatgacgccatccacaccctgaagcagctccatcactgacccctgcagccgatgctccagatctgagatgagctctctcagggactgggtctgctgcaccatctcagtttcagagttcgtaaggcttttcagaatgtcttcctcctccttctccaggttttgcagctcattgctctcctcccagtccaggatgtctctcagttgctcaaaatctgccaagacgttggttttgtcatactgtatttgagtcttccaggaagctttctcttctctgatgtcagcttccaactcttcagcttcctgctgcttctgcctcagcatctccagagctgcctggagcttcacttggtactcccgggcaacctcctctgtgaggaacgtgtggtgaccacggtgctcctgagaccgctcacaaagccagcaaatgaccttcccgtcctcctgacagaagagtagaagtttctctccatggcgtgcacaatgatcaactttctgcccctctgggctcaacttgacctccctgagcttctccactatgttggctacatgccgattaggccgtatgttctcaggctggtaactgatccggcacacagggcagctactctctcctttgtctagcatggacttcttgtggtttgcagtgaggcatgcttggcagaagctgtggccgcagtccaggctcaggggttgtgtcaggagttccaggcagatggggcaggtcacctcctcctttacattaaccaggattccagaagccatagtagctattccactgctcctgcctgtcctggctgctgaggttcctcttgttca

SEQ ID NO: 279523 - DNA, 2923 bp, Homo sapiens
gtgtgatctcggctcactgcaacctctgtctcctgggttcaagcgatcctcctgtctcagcctcccgagtaactgggattacaggcgcccaccaccatgcccggctaatttttgtatttttgtagacagggtttcgacatgttggccaggctggtctcaaactcctgacctcaagtgatccacccgcctcagcctcccaaagtgctgggattacaggtgtgagccactgcgcccgtcctgactcatgcaacttctgcttcagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctccttaatgtttccctgatgtgatactttgagagcccaggatgccagtacaataattgaaattcacaaatgtctggtatcttgtccctcgtgccccatatattatctgtggtttcggagagctcacttgtctcttatcttcagaaatgacagcacatgaaatgttgtttggagccactgtcacatcaactgtagaaaaattaacaggtcagctaagggatataatgtaactttatttgtgatatgagagaaatcttgataaagacttgagagaaaactgggaggaaccttgtttagaagttataaggaggggtaagttatgtgtgtcttggaaggagaatcataaatcttaaaacatgagcctaatagagaacataaaattctaaaagataaagataataataatgataagccgcagggtggcttatgataatgtgacttctccttaccccagtagcgtcggacatctgtcagctctgaaatgataaaaatgcacaatattgaatacaaacaaaggagtcagcactgaaattcattttctctccagattagggaaagagtaggtatgccctatggtagggcagtaaattgttgaattccataaccctgttgttgatctagctctcctcacctctaaacacttctagcattcctttcagatcaggagctcgaaacactctcctttgattttttggaaaagtttctggcttcttcaaggtcacgttctccgtcctttttatgacgccatccacaccctgaagcagctccatcactgacccctgcagccgatgctccagatctgagatgagctctctcagggactgggtctgctgcaccatctcagtttcagagttcgtaaggcttttcagaatgtcttcctcctccttctccaggttttgcagctcattgctctcctcccagtccaggatgtctctcagttgctcaaaatctgccaagacgttggttttgtcatactgtatttgagtcttccaggaagctttctcttctctgatgtcagcttccaactcttcagcttcctgctgcttctgcctcagcatctccagagctgcctggagcttcacttggtactcccgggcaacctcctctgtgaggaacgtgtggtgaccacggtgctcctgagaccgctcacaaagccagcaaatgaccttcccgtcctcctgacagaagagtagaagtttctctccatggcgtgcacaatgatcaactttctgcccctctgggctcaacttgacctccctgagcttctccactatgttggctacatgccgattaggccgtatgttctcaggctggtaactgatccggcacacagggcagctactctctcctttgtctagcatggacttcttgtggtttgcagtgaggcatgcttggcagaagctgtggccgcagtccaggctcaggggttgtgtcaggagttccaggcagatggggcaggtcacctcctcctttacattaaccaggattccagaagccatagtagctattccactgctcctgcctgtcctggctgctgaggttcctcttgttca

SEQ ID NO: 279524 - DNA, 2277 bp, Homo sapiens
agatgagccttccgcaaactcctgacctgtgggtccgtccgttcaacggccaaaggctggcggaggagggatcccctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaagacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggcataacgagacccatgtccccgttctcatctgctgatgttgtaccttttcctacagttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctaggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttgaggacgaacagggcattgccgaatcttttaggagattccgtctcaaaaaaaacaacacaaggaagggaaaaaaaaatagcatttataccctcttacagtgggtatcaagccgcccatgaaaacttctgaaacactcgcagaattcagggtggaatactcccaaaagcaagacttctataacgtttcaacctcacctcgtacattcctgtataggtaagacagtctccgttgaaaaaagcccaaggctaagtgatctaacaaagacggtaccacgtacaggtgacggtacgttaacccagtatgtgaccaaattgacagacaa

SEQ ID NO: 279525 - DNA, 945 bp, Homo sapiens
cgcttggggttccgcgcccccaagttcccggtgctcccgcccctcgccccagcggctgcaacatcagcgcgcagaggagtttctgcgagcacccgggagttgtagccaccgcttccccacccccgactcagcaggacagccccagaacgggaccccacagccagtcagctgggtcagctccccagcagcgaagccgggagcccgaggacccggggacgcgcggtgggggcggcggccgagctgctgcggcgctcagggcttgggggcgcccccgttctgcagatgcgcttttcagggggtggggagtcaagagcctgtggctcttccgtcacggggtaaacggtaacacctgggcggccgcgactctgcgagcgttctggcctcggcgggcggcggggaaccgcagtgatgcccgagctcgccccttttgtgtcctcgcggtgagccccgttccgaagccggaagcttgggaacgctctaactgggagaacggcgctcggctggtcaattcattccgctcctcggaaacaatgagctggatccttgacttgaatgtgctggcggagcggggtttgtaagccggcgtttcatccagctctggtcctcaaggcgccctttgtaccacccgcaggtggccgaggctactgcacgtattttcgaaatcaccgagtgtgggtgtttggggcaggtatcaccccgcgaggaccatctcagactgagagttggtttaggagttttgaacagattggatacagaactatattgtgttttgtatttagaccgggggaaagactagaatgttaactctagggtccagtttgtcatctaacagaattccgggcttgggtaggtcctgtaatgcggtacaataacaaccaggtgttaaaaccggcatcttctggattctcagattctgtagacagcatacttctaaaaaatgtagag

SEQ ID NO: 279526 - DNA, 908 bp, Homo sapiens
cgcttggggttccgcgcccccaagttcccggtgctcccgcccctcgccccagcggctgcaacatcagcgcgcagaggagtttctgcgagcacccgggagttgtagccaccgcttccccacccccgactcagcaggacagccccagaacgggaccccacagccagtcagctgggtcagctccccagcagcgaagccgggagcccgaggacccggggacgcgcggtgggggcggcggccgagctgctgcggcgctcagggcttgggggcgcccccgttctgcagatgcgcttttcagggggtggggagtcaagagcctgtggctcttccgtcacggggtaaacggtaacacctgggcggccgcgactctgcgagcgttctggcctcggcgggcggcggggaaccgcagtgatgcccgagctcgccccttttgtgtcctcgcggtgagccccgttccgaagccggaagcttgggaacgctctaactgggagaacggcgctcggctggtcaattcattccgctcctcggaaacaatgagctggatccttgacttgaatgtgctggcggagcggggtttagcgtttattgagaacctactatgcctaggataattcctgaccaatacaagagagacagtttccatggagatgtgatcggtaaggtggtggagactcagagtgatggatgggctccctttgattggtggtccaggaagcctctaggaggaggaggtggcaacatttaaactgagaccttaatgatattgatgagttcctgttttatcagatctaagatatctttgaaatatttcaatttttaatgaaatatacagttttaaaatgttccactttaaaatgtaccacaaagaaagaaaaactactgtcaataaaattggcaccatctactgtaag

SEQ ID NO: 279527 - DNA, 5500 bp, Homo sapiens
aatggcggaagtggcaccgttgccaggcagccgttgcctggcgtcgcggggcgtactctgcgctgggcgcgcggaggcctaggcgggaagctcgagcggcggcgccatggcccgaggtagcgcgcggctggcgggggtcccgaggatcccgggttccggggttccggggtccagggtcggcggccggagcgctcagggcccccgcctaggccctgaggccagagtccccgctcaggcagggtcccgtctgccgggcgcccaccctcgggctcccggagcttggcttccctcgggcgcccggcctcgtcccgccagcctagctggcgttggcgtcgccggggaaggcgcggagagccccggctcctgcctggtccccgaggcccggcccagccccgcagtggccccggctcgcgtggccgagtcccctgacgcccggcgcccgctccccgcagcgtggcagcacccgttcctcaacgtcttcagacacttccgggtggacgagtggaagcgctccgccaagcagggggacgtggccgtggtcacggacaagaccctgaagggcgccgtgtatcgcattcggggctcagtctctgccgccaactacatccagctccctaagagcagcacccagtctctggggctgacgggacgatacctgtatgtgctctttcggcccctgcccagcaagcacttcgtcatccacctcgatgtgtcctccaaggacaaccaagtcatccgtgtgtctttctccaacctcttcaaggagtttaagtctacggccacgtggctccagtttcccttggtcctggaggccaggacacctcagagagatctggtgggtttggccccctccggagcccgctggacctgcctgcagctcgatctgcaggacgttctcctggtctacctgaaccggtgctacggccatctcaagagcatcaggctgtgcgccagcctgctggtcaggaacctgtacaccagtgacctgtgctttgagcctgccatctctggggcccagtgggcaaagctgcccgtgactcctatgcctcgggaaatggcattccctgtgcccaagggagagagctggcatgaccgctacatccacgtccggtttccaagtgagagcttgaaagtgccttccaagccgattgagaagagctgttcccctcctgaggcagtcctcctggggccggggccacagcctctcccttgcccggtggcctccagcaaacctgtgcggttcagtgtgtctccagtggtccagacgcccagccccacagcccagtccggccgggccgccttggcacccaggcccttcccggaggtcagcctgtcccaagagcgctcagacgcctccaacgcggatggccccggtttccatagccttgagccctgggcccagctggaggcctctgacatccacacggctgctgccggcacccacgtgttgactcacgagtcggctgaggtgcccgtggcccgcaccggctcctgcgaaggcttcctcccagacccagtcctgaggctcaagggcgtcatcggctttgggggccacggcaccagacaggccctgtggaccccagacggggcggctgtcgtgtacccctgccatgcggtcatcgtcgtcctgctcgtggacacgggggagcagcgcttcttccttggccacacagacaaggtctccgccctggcgctggatggcagcagctcactattggcctcggcccaggcaagggcccctagtgtgatgcggctctgggacttccagaccgggcggtgcttgtgcctgttccggagcccaatgcacgttgtctgctctctcagcttctctgacagcggggcccttctctgcggggttggcaaggaccaccacgggaggacggtaacagggccctggctgcgggttggggtggggctgtcctgatgcacgcagacagctggaagggtcttggttttctgaaactccagcttcatgtgaccctgggtccctgctctgtgtcctccctgtggtggggctccctgcactctggtgttcatgccgcccccgtgccctgcacaaaaaccaccaccagcagctcacatttcacgtctcggcttttcggccatcggagtcggtttaagccagcgtttacacacctcgcctcgttctctctgctggtgatgcggttgtaagattttcacgtggcagagcccctgcagctgacccacgcttgggcatcaatggcacctccacacagccgaagcacccggcatcttggtgggggcacctttttaaacattttttttttgagagagagccttgttctgtcacctaggctggaatgcagtggtgcaatcatagctcactgcagccttgaccccctccctgacctccccgccagctggactccagccatcctcctgcctcagcttcccagatagctgggccacaggcgtgtgccaccacacctggctaacttttttttttttttttttttgagatggcatcttgctctgtcgcccaggatggagtgcagtggcgcgatcttagctcactgcaagctccgcctcccaggttcacaccattctcctgcctcagcctccccagtagctgggactacaggcgcctgccaacatgcctggctaattttttttttttgtatttttagtagagataggctttcaccttgttagccaggatggtctcacgttttgtttttttaactttttgtagagatagggtttcattacattgctcaggctggtctcaaactccagggctcaagcagtcctcccacctcagcctcccaaagtgctgggatcacaggcatgagccactgtgcccagccacgagctgctttttatccaccttccggcttgcgggggggtttgtacttctctgcgaatgggttgcagtgctcagcattgcgggtctctgtagaagtcccaaagcttcaggatgagaagatggaggggctggtttccttccactctccacggccgcacgctcagaggctggtctccgcatgagagaaaagccacctccgggtggggctcggctgggccttgcagaatcgaggtggccccgactggccctgccgtgcgggctcagcctgggcttgttgcagatggtggtggcctggggcaccggccaggtgggcctcggtggcgaggtggtcgttctggcaaaggcgcacactgactttgacgtccaggccttccgggtcaccttttttgatgaaaccaggatggcgtcgtgcgggcagggcagtgtgcggctctggcggctgcgtggcggggtgctgcgttcctgccccgtggacttaggggagcaccacgcgctgcagttcaccgacctggccttcaagcaggcccgggacggctgcccggagccctcggctgccatgctcttcgtgtgcagccgcagtggccacatcttggagattgactgtcagcgcatggtcgtgcggcatgcccgccgcctgctccccacacggactccaggcggtccccacccacagaagcagaccttcagctcaggccccggcattgccatcagcagcctcagcgtctccccggccatgtgtgctgtgggctctgaggacggcttcttgcggctctggcccctggacttctcctcggtgctcctggaggcaggtgatgctgtgggcacgctctcccaactccgggagagcctcgcctggatgctggggcggggaaggcccagtccccggggctctgctgtcagccgccctggctcctggctgcacagggtgccacggggccaagtggcatatccagagccctggggcggctgatgccagggcggcccgcggggcagcctcacggaagggcccggtgggacgtgggtagtgtgtgaagcccctcagcctgggtcccgcctagcctaagagtggtggcctcgagggagctgcatcttgcagccgtgtggagcctgggactttgagcagcagggagtgcatttgctggggtgtcggggacccgaagcctgagcatgcggctcaccccggggtggccctggaggcccctgaccccaccccacccacagagcacgagggccccgtcagctcagtctgtgtcagccccgatggcctccgtgtgctgtctgccacctcctcgggccacctgggcttcctggacacgctgtcccgggtgtaccacatgctggctcgctcccacaccgccccggtgttggccctcgccatggagcagaggcggggacagctggccaccgtgtcccaggaccgtaccgtccgcatctgggacctggccaccctgcagcagctatacgacttcacatcatcagaggacgccccgtgcgctgtcaccttccaccccacaaggccaacctttttctgtggctttagcagtggggccgtgcgctccttcagcctggaggccgctgaggtcctggtggaacacacgtgccaccgaggagctgtcaccggcctgaccgccacccctgacggccgcctgctcttcagctcctgctcccagggctccctggcccagtacagctgtgcggacccccagtggcatgtcctccgagtggcagcggacatggtatgcccggatgcccccgcgagccccagcgccctggcagtcagcagggatggccgcctgctggcctttgtgggaccctccaggtgcacagtgacagtcatgggctcggcctcccttgatgagctgctgcgagttgacatcggcactctggacctggccagcagccgcctggactcagccatggctgtgtgctttggccctgcagctctgggccacctgctggtgtccacctcgtccaacagagtcgtggtgctggatgctgtgtcgggccgcatcatccgggagctgcccggtgtccaccctgagccctgcccctccttgacgctcagtgaggacgcccgcttcctgctgattgccgccggccggaccatcaaggtgtgggactacgccacacaggccagcccaggcccccaggtgtacatcggccactcggaacccgtgcaggctgtggccttctctcctgaccagcagcaggtcctcagcgcaggggacgccgtcttcctctgggatgtcctggcccctactgagagcgaccaaagcttccccggggcccccccagcctgcaagacaggcccgggcgcaggaccgctggaggacgcagcgtccagggccagcgagctcccccggcagcaggtccccaagccatgtcaggcatctccaccacggctgggcgtctgtgccaggcctcccgaaggtggcgatggcgccagggacaccaggaattcgggggccccacgcaccacctacctggcttcctgcaaggccttcacgcctgccagggtcagctgcagcccccactctgccaagggcacttgcccgcctcccgccagcggtgggtggctgcgtctgaaggctgtcgtcggttacagcgggaatgggcgggccaacatggtctggaggccggacacaggcttctttgcctacacgtgcggccgct

SEQ ID NO: 279528 - DNA, 532 bp, Homo sapiens
ttacaccatgttagcaaggctggtcttgaactctttgacctaaggttatctaccaaacctcagcctcccaaagtgctgggatcacaggcatgagccactgtgcccagccacgagctgctttttatccaccttccggcttgcgggggggtttgtacttctctgcgaatgggttgcagtgctcagcattgcgggtctctgtagaagtcccaaagcttcaggatgagaagatggaggggctggtttccttccactctccacggccgcacgctcagaggctggtctccgcatgagagaaaagccacctccgggtggggctcggctgggccttgcagaatcgaggtggccccgactggccctgccgtgcgggctcagcctgggcttgttgcagatggtggtggcctggggcaccggccaggtgggcctcggtggcgaggtggtcgttctggcaaaggcgcacactgactttgacgtccaggccttccgggtcaccttttttgatgaaaccaggtgatgcagccgcccatccacgatg

SEQ ID NO: 279529 - DNA, 3527 bp, Homo sapiens
aatggcggaagtggcaccgttgccaggcagccgttgcctggcgtcgcggggcgtactctgcgctgggcgcgcggaggcctaggcgggaagctcgagcggcggcgccatggcccgagcgtggcagcacccgttcctcaacgtcttcagacacttccgggtggacgagtggaagcgctccgccaagcagggggacgtggccgtggtcacggacaagaccctgaagggcgccgtgtatcgcattcggggctcagtctctgccgccaactacatccagctccctaagagcagcacccagtctctggggctgacgggacgatacctgtatgtgctctttcggcccctgcccagcaagcacttcgtcatccacctcgatgtgtcctccaaggacaaccaagtcatccgtgtgtctttctccaacctcttcaaggagtttaagtctacggccacgtggctccagtttcccttggtcctggaggccaggacacctcagagagatctggtgggtttggccccctccggagcccgctggacctgcctgcagctcgatctgcaggacgttctcctggtctacctgaaccggtgctacggccatctcaagagcatcaggctgtgcgccagcctgctggtcaggaacctgtacaccagtgacctgtgctttgagcctgccatctctggggcccagtgggcaaagctgcccgtgactcctatgcctcgggaaatggcattccctgtgcccaagggagagagctggcatgaccgctacatccacgtccggtttccaagtgagagcttgaaagtgccttccaagccgattgagaagagctgttcccctcctgaggcagtcctcctggggccggggccacagcctctcccttgcccggtggcctccagcaaacctgtgcggttcagtgtgtctccagtggtccagacgcccagccccacagcccagtccggccgggccgccttggcacccaggcccttcccggaggtcagcctgtcccaagagcgctcagacgcctccaacgcggatggccccggtttccatagccttgagccctgggcccagctggaggcctctgacatccacacggctgctgccggcacccacgtgttgactcacgagtcggctgaggtgcccgtggcccgcaccggctcctgcgaaggcttcctcccagacccagtcctgaggctcaagggcgtcatcggctttgggggccacggcaccagacaggccctgtggaccccagacggggcggctgtcgtgtacccctgccatgcggtcatcgtcgtcctgctcgtggacacgggggagcagcgcttcttccttggccacacagacaaggtctccgccctggcgctggatggcagcagctcactattggcctcggcccaggcaagggcccctagtgtgatgcggctctgggacttccagaccgggcggtgcttgtgcctgttccggagcccaatgcacgttgtctgctctctcagcttctctgacagcggggcccttctctgcggggttggcaaggaccaccacgggaggacgatggtggtggcctggggcaccggccaggtgggcctcggtggcgaggtggtcgttctggcaaaggcgcacactgactttgacgtccaggccttccgggtcaccttttttgatgaaaccaggatggcgtcgtgcgggcagggcagtgtgcggctctggcggctgcgtggcggggtgctgcgttcctgccccgtggacttaggggagcaccacgcgctgcagttcaccgacctggccttcaagcaggcccgggacggctgcccggagccctcggctgccatgctcttcgtgtgcagccgcagtggccacatcttggagattgactgtcagcgcatggtcgtgcggcatgcccgccgcctgctccccacacggactccaggcggtccccacccacagaagcagaccttcagctcaggccccggcattgccatcagcagcctcagcgtctccccggccatgtgtgctgtgggctctgaggacggcttcttgcggctctggcccctggacttctcctcggtgctcctggaggcagagcacgagggccccgtcagctcagtctgtgtcagccccgatggcctccgtgtgctgtctgccacctcctcgggccacctgggcttcctggacacgctgtcccgggtgtaccacatgctggctcgctcccacaccgccccggtgttggccctcgccatggagcagaggcggggacagctggccaccgtgtcccaggaccgtaccgtccgcatctgggacctggccaccctgcagcagctatacgacttcacatcatcagaggacgccccgtgcgctgtcaccttccaccccacaaggccaacctttttctgtggctttagcagtggggccgtgcgctccttcagcctggaggccgctgaggtcctggtggaacacacgtgccaccgaggagctgtcaccggcctgaccgccacccctgacggccgcctgctcttcagctcctgctcccagggctccctggcccagtacagctgtgcggacccccagtggcatgtcctccgagtggcagcggacatggtatgcccggatgcccccgcgagccccagcgccctggcagtcagcagggatggccgcctgctggcctttgtgggaccctccaggtgcacagtgacagtcatgggctcggcctcccttgatgagctgctgcgagttgacatcggcactctggacctggccagcagccgcctggactcagccatggctgtgtgctttggccctgcagctctgggccacctgctggtgtccacctcgtccaacagagtcgtggtgctggatgctgtgtcgggccgcatcatccgggagctgcccggtgtccaccctgagccctgcccctccttgacgctcagtgaggacgcccgcttcctgctgattgccgccggccggaccatcaaggtgtgggactacgccacacaggccagcccaggcccccaggtgtacatcggccactcggaacccgtgcaggctgtggccttctctcctgaccagcagcaggtcctcagcgcaggggacgccgtcttcctctgggatgtcctggcccctactgagagcgaccaaagcttccccggggcccccccagcctgcaagacaggcccgggcgcaggaccgctggaggacgcagcgtccagggccagcgagctcccccggcagcaggtccccaagccatgtcaggcatctccaccacggctgggcgtctgtgccaggcctcccgaaggtggcgatggcgccagggacaccaggaattcgggggccccacgcaccacctacctggcttcctgcaaggccttcacgcctgccagggtcagctgcagcccccactctgccaagggcacttgcccgcctcccgccagcggtgggtggctgcgtctgaaggctgtcgtcggttacagcgggaatgggcgggccaacatggtctggaggccggacacaggcttctttgcctacacgtgcggccgct

SEQ ID NO: 279530 - DNA, 3776 bp, Homo sapiens
aatggcggaagtggcaccgttgccaggcagccgttgcctggcgtcgcggggcgtactctgcgctgggcgcgcggaggcctaggcgggaagctcgagcggcggcgccatggcccgaggtagcgcgcggctggcgggggtcccgaggatcccgggttccggggttccggggtccagggtcggcggccggagcgctcagggcccccgcctaggccctgaggccagagtccccgctcaggcagggtcccgtctgccgggcgcccaccctcgggctcccggagcttggcttccctcgggcgcccggcctcgtcccgccagcctagctggcgttggcgtcgccggggaaggcgcggagagccccggctcctgcctggtccccgaggcccggcccagccccgcagtggccccggctcgcgtggccgagtcccctgacgcccggcgcccgctccccgcagcgtggcagcacccgttcctcaacgtcttcagacacttccgggtggacgagtggaagcgctccgccaagcagggggacgtggccgtggtcacggacaagaccctgaagggcgccgtgtatcgcattcggggctcagtctctgccgccaactacatccagctccctaagagcagcacccagtctctggggctgacgggacgatacctgtatgtgctctttcggcccctgcccagcaagcacttcgtcatccacctcgatgtgtcctccaaggacaaccaagtcatccgtgtgtctttctccaacctcttcaaggagtttaagtctacggccacgtggctccagtttcccttggtcctggaggccaggacacctcagagagatctggtgggtttggccccctccggagcccgctggacctgcctgcagctcgatctgcaggacgttctcctggtctacctgaaccggtgctacggccatctcaagagcatcaggctgtgcgccagcctgctggtcaggaacctgtacaccagtgacctgtgctttgagcctgccatctctggggcccagtgggcaaagctgcccgtgactcctatgcctcgggaaatggcattccctgtgcccaagggagagagctggcatgaccgctacatccacgtccggtttccaagtgagagcttgaaagtgccttccaagccgattgagaagagctgttcccctcctgaggcagtcctcctggggccggggccacagcctctcccttgcccggtggcctccagcaaacctgtgcggttcagtgtgtctccagtggtccagacgcccagccccacagcccagtccggccgggccgccttggcacccaggcccttcccggaggtcagcctgtcccaagagcgctcagacgcctccaacgcggatggccccggtttccatagccttgagccctgggcccagctggaggcctctgacatccacacggctgctgccggcacccacgtgttgactcacgagtcggctgaggtgcccgtggcccgcaccggctcctgcgaaggcttcctcccagacccagtcctgaggctcaagggcgtcatcggctttgggggccacggcaccagacaggccctgtggaccccagacggggcggctgtcgtgtacccctgccatgcggtcatcgtcgtcctgctcgtggacacgggggagcagcgcttcttccttggccacacagacaaggtctccgccctggcgctggatggcagcagctcactattggcctcggcccaggcaagggcccctagtgtgatgcggctctgggacttccagaccgggcggtgcttgtgcctgttccggagcccaatgcacgttgtctgctctctcagcttctctgacagcggggcccttctctgcggggttggcaaggaccaccacgggaggacgatggtggtggcctggggcaccggccaggtgggcctcggtggcgaggtggtcgttctggcaaaggcgcacactgactttgacgtccaggccttccgggtcaccttttttgatgaaaccaggatggcgtcgtgcgggcagggcagtgtgcggctctggcggctgcgtggcggggtgctgcgttcctgccccgtggacttaggggagcaccacgcgctgcagttcaccgacctggccttcaagcaggcccgggacggctgcccggagccctcggctgccatgctcttcgtgtgcagccgcagtggccacatcttggagattgactgtcagcgcatggtcgtgcggcatgcccgccgcctgctccccacacggactccaggcggtccccacccacagaagcagaccttcagctcaggccccggcattgccatcagcagcctcagcgtctccccggccatgtgtgctgtgggctctgaggacggcttcttgcggctctggcccctggacttctcctcggtgctcctggaggcagagcacgagggccccgtcagctcagtctgtgtcagccccgatggcctccgtgtgctgtctgccacctcctcgggccacctgggcttcctggacacgctgtcccgggtgtaccacatgctggctcgctcccacaccgccccggtgttggccctcgccatggagcagaggcggggacagctggccaccgtgtcccaggaccgtaccgtccgcatctgggacctggccaccctgcagcagctatacgacttcacatcatcagaggacgccccgtgcgctgtcaccttccaccccacaaggccaacctttttctgtggctttagcagtggggccgtgcgctccttcagcctggaggccgctgaggtcctggtggaacacacgtgccaccgaggagctgtcaccggcctgaccgccacccctgacggccgcctgctcttcagctcctgctcccagggctccctggcccagtacagctgtgcggacccccagtggcatgtcctccgagtggcagcggacatggtatgcccggatgcccccgcgagccccagcgccctggcagtcagcagggatggccgcctgctggcctttgtgggaccctccaggtgcacagtgacagtcatgggctcggcctcccttgatgagctgctgcgagttgacatcggcactctggacctggccagcagccgcctggactcagccatggctgtgtgctttggccctgcagctctgggccacctgctggtgtccacctcgtccaacagagtcgtggtgctggatgctgtgtcgggccgcatcatccgggagctgcccggtgtccaccctgagccctgcccctccttgacgctcagtgaggacgcccgcttcctgctgattgccgccggccggaccatcaaggtgtgggactacgccacacaggccagcccaggcccccaggtgtacatcggccactcggaacccgtgcaggctgtggccttctctcctgaccagcagcaggtcctcagcgcaggggacgccgtcttcctctgggatgtcctggcccctactgagagcgaccaaagcttccccggggcccccccagcctgcaagacaggcccgggcgcaggaccgctggaggacgcagcgtccagggccagcgagctcccccggcagcaggtccccaagccatgtcaggcatctccaccacggctgggcgtctgtgccaggcctcccgaaggtggcgatggcgccagggacaccaggaattcgggggccccacgcaccacctacctggcttcctgcaaggccttcacgcctgccagggtcagctgcagcccccactctgccaaggctttggggcacaggtggccatgctgggccccagcagcatccg

SEQ ID NO: 279531 - DNA, 2781 bp, Homo sapiens
ttacaccatgttagcaaggctggtcttgaactctttgacctaaggttatctaccaaacctcagcctcccaaagtgctgggatcacaggcatgagccactgtgcccagccacgagctgctttttatccaccttccggcttgcgggggggtttgtacttctctgcgaatgggttgcagtgctcagcattgcgggtctctgtagaagtcccaaagcttcaggatgagaagatggaggggctggtttccttccactctccacggccgcacgctcagaggctggtctccgcatgagagaaaagccacctccgggtggggctcggctgggccttgcagaatcgaggtggccccgactggccctgccgtgcgggctcagcctgggcttgttgcagatggtggtggcctggggcaccggccaggtgggcctcggtggcgaggtggtcgttctggcaaaggcgcacactgactttgacgtccaggccttccgggtcaccttttttgatgaaaccaggatggcgtcgtgcgggcagggcagtgtgcggctctggcggctgcgtggcggggtgctgcgttcctgccccgtggacttaggggagcaccacgcgctgcagttcaccgacctggccttcaagcaggcccgggacggctgcccggagccctcggctgccatgctcttcgtgtgcagccgcagtggccacatcttggagattgactgtcagcgcatggtcgtgcggcatgcccgccgcctgctccccacacggactccaggcggtccccacccacagaagcagaccttcagctcaggccccggcattgccatcagcagcctcagcgtctccccggccatgtgtgctgtgggctctgaggacggcttcttgcggctctggcccctggacttctcctcggtgctcctggaggcaggtgatgctgtgggcacgctctcccaactccgggagagcctcgcctggatgctggggcggggaaggcccagtccccggggctctgctgtcagccgccctggctcctggctgcacagggtgccacggggccaagtggcatatccagagccctggggcggctgatgccagggcggcccgcggggcagcctcacggaagggcccggtgggacgtgggtagtgtgtgaagcccctcagcctgggtcccgcctagcctaagagtggtggcctcgagggagctgcatcttgcagccgtgtggagcctgggactttgagcagcagggagtgcatttgctggggtgtcggggacccgaagcctgagcatgcggctcaccccggggtggccctggaggcccctgaccccaccccacccacagagcacgagggccccgtcagctcagtctgtgtcagccccgatggcctccgtgtgctgtctgccacctcctcgggccacctgggcttcctggacacgctgtcccgggtgtaccacatgctggctcgctcccacaccgccccggtgttggccctcgccatggagcagaggcggggacagctggccaccgtgtcccaggaccgtaccgtccgcatctgggacctggccaccctgcagcagctatacgacttcacatcatcagaggacgccccgtgcgctgtcaccttccaccccacaaggccaacctttttctgtggctttagcagtggggccgtgcgctccttcagcctggaggccgctgaggtcctggtggaacacacgtgccaccgaggagctgtcaccggcctgaccgccacccctgacggccgcctgctcttcagctcctgctcccagggctccctggcccagtacagctgtgcggacccccagtggcatgtcctccgagtggcagcggacatggtatgcccggatgcccccgcgagccccagcgccctggcagtcagcagggatggccgcctgctggcctttgtgggaccctccaggtgcacagtgacagtcatgggctcggcctcccttgatgagctgctgcgagttgacatcggcactctggacctggccagcagccgcctggactcagccatggctgtgtgctttggccctgcagctctgggccacctgctggtgtccacctcgtccaacagagtcgtggtgctggatgctgtgtcgggccgcatcatccgggagctgcccggtgtccaccctgagccctgcccctccttgacgctcagtgaggacgcccgcttcctgctgattgccgccggccggaccatcaaggtgtgggactacgccacacaggccagcccaggcccccaggtgtacatcggccactcggaacccgtgcaggctgtggccttctctcctgaccagcagcaggtcctcagcgcaggggacgccgtcttcctctgggatgtcctggcccctactgagagcgaccaaagcttccccggggcccccccagcctgcaagacaggcccgggcgcaggaccgctggaggacgcagcgtccagggccagcgagctcccccggcagcaggtccccaagccatgtcaggcatctccaccacggctgggcgtctgtgccaggcctcccgaaggtggcgatggcgccagggacaccaggaattcgggggccccacgcaccacctacctggcttcctgcaaggccttcacgcctgccagggtcagctgcagcccccactctgccaagggcacttgcccgcctcccgccagcggtgggtggctgcgtctgaaggctgtcgtcggttacagcgggaatgggcgggccaacatggtctggaggccggacacaggcttctttgcctacacgtgcggccgct

SEQ ID NO: 279532 - DNA, 425 bp, Homo sapiens
tggcctccagacgggactctgtggtggcctcctgctgacctgccttcccctctcacccagcagctgcccttgatgagagccccacgggcctgtgcccctcctggccctggcacagtgcccacagctcccacacctcctaccccagcttccccgtctgcccctgggtgtcctctgcagctggcctgggtgtgccccaacacagcctcccatgtgcaggctttggggcacaggtggccatgctgggccccagcagcatccgggtctccttcctcgcagggcacttgcccgcctcccgccagcggtgggtggctgcgtctgaaggctgtcgtcggttacagcgggaatgggcgggccaacatggtctggaggccggacacaggtgggggccaagagcctacccccacccccagccaagatgcggccgc

SEQ ID NO: 279533 - DNA, 3863 bp, Homo sapiens
aatggcggaagtggcaccgttgccaggcagccgttgcctggcgtcgcggggcgtactctgcgctgggcgcgcggaggcctaggcgggaagctcgagcggcggcgccatggcccgaggtagcgcgcggctggcgggggtcccgaggatcccgggttccggggttccggggtccagggtcggcggccggagcgctcagggcccccgcctaggccctgaggccagagtccccgctcaggcagggtcccgtctgccgggcgcccaccctcgggctcccggagcttggcttccctcgggcgcccggcctcgtcccgccagcctagctggcgttggcgtcgccggggaaggcgcggagagccccggctcctgcctggtccccgaggcccggcccagccccgcagtggccccggctcgcgtggccgagtcccctgacgcccggcgcccgctccccgcagcgtggcagcacccgttcctcaacgtcttcagacacttccgggtggacgagtggaagcgctccgccaagcagggggacgtggccgtggtcacggacaagaccctgaagggcgccgtgtatcgcattcggggctcagtctctgccgccaactacatccagctccctaagagcagcacccagtctctggggctgacgggacgatacctgtatgtgctctttcggcccctgcccagcaagcacttcgtcatccacctcgatgtgtcctccaaggacaaccaagtcatccgtgtgtctttctccaacctcttcaaggagtttaagtctacggccacgtggctccagtttcccttggtcctggaggccaggacacctcagagagatctggtgggtttggccccctccggagcccgctggacctgcctgcagctcgatctgcaggacgttctcctggtctacctgaaccggtgctacggccatctcaagagcatcaggctgtgcgccagcctgctggtcaggaacctgtacaccagtgacctgtgctttgagcctgccatctctggggcccagtgggcaaagctgcccgtgactcctatgcctcgggaaatggcattccctgtgcccaagggagagagctggcatgaccgctacatccacgtccggtttccaagtgagagcttgaaagtgccttccaagccgattgagaagagctgttcccctcctgaggcagtcctcctggggccggggccacagcctctcccttgcccggtggcctccagcaaacctgtgcggttcagtgtgtctccagtggtccagacgcccagccccacagcccagtccggccgggccgccttggcacccaggcccttcccggaggtcagcctgtcccaagagcgctcagacgcctccaacgcggatggccccggtttccatagccttgagccctgggcccagctggaggcctctgacatccacacggctgctgccggcacccacgtgttgactcacgagtcggctgaggtgcccgtggcccgcaccggctcctgcgaaggcttcctcccagacccagtcctgaggctcaagggcgtcatcggctttgggggccacggcaccagacaggccctgtggaccccagacggggcggctgtcgtgtacccctgccatgcggtcatcgtcgtcctgctcgtggacacgggggagcagcgcttcttccttggccacacagacaaggtctccgccctggcgctggatggcagcagctcactattggcctcggcccaggcaagggcccctagtgtgatgcggctctgggacttccagaccgggcggtgcttgtgcctgttccggagcccaatgcacgttgtctgctctctcagcttctctgacagcggggcccttctctgcggggttggcaaggaccaccacgggaggacgatggtggtggcctggggcaccggccaggtgggcctcggtggcgaggtggtcgttctggcaaaggcgcacactgactttgacgtccaggccttccgggtcaccttttttgatgaaaccaggatggcgtcgtgcgggcagggcagtgtgcggctctggcggctgcgtggcggggtgctgcgttcctgccccgtggacttaggggagcaccacgcgctgcagttcaccgacctggccttcaagcaggcccgggacggctgcccggagccctcggctgccatgctcttcgtgtgcagccgcagtggccacatcttggagattgactgtcagcgcatggtcgtgcggcatgcccgccgcctgctccccacacggactccaggcggtccccacccacagaagcagaccttcagctcaggccccggcattgccatcagcagcctcagcgtctccccggccatgtgtgctgtgggctctgaggacggcttcttgcggctctggcccctggacttctcctcggtgctcctggaggcagagcacgagggccccgtcagctcagtctgtgtcagccccgatggcctccgtgtgctgtctgccacctcctcgggccacctgggcttcctggacacgctgtcccgggtgtaccacatgctggctcgctcccacaccgccccggtgttggccctcgccatggagcagaggcggggacagctggccaccgtgtcccaggaccgtaccgtccgcatctgggacctggccaccctgcagcagctatacgacttcacatcatcagaggacgccccgtgcgctgtcaccttccaccccacaaggccaacctttttctgtggctttagcagtggggccgtgcgctccttcagcctggaggccgctgaggtcctggtggaacacacgtgccaccgaggagctgtcaccggcctgaccgccacccctgacggccgcctgctcttcagctcctgctcccagggctccctggcccagtacagctgtgcggacccccagtggcatgtcctccgagtggcagcggacatggtatgcccggatgcccccgcgagccccagcgccctggcagtcagcagggatggccgcctgctggcctttgtgggaccctccaggtgcacagtgacagtcatgggctcggcctcccttgatgagctgctgcgagttgacatcggcactctggacctggccagcagccgcctggactcagccatggctgtgtgctttggccctgcagctctgggccacctgctggtgtccacctcgtccaacagagtcgtggtgctggatgctgtgtcgggccgcatcatccgggagctgcccggtgtccaccctgagccctgcccctccttgacgctcagtgaggacgcccgcttcctgctgattgccgccggccggaccatcaaggtgtgggactacgccacacaggccagcccaggcccccaggtgtacatcggccactcggaacccgtgcaggctgtggccttctctcctgaccagcagcaggtcctcagcgcaggggacgccgtcttcctctgggatgtcctggcccctactgagagcgaccaaagcttccccggggcccccccagcctgcaagacaggcccgggcgcaggaccgctggaggacgcagcgtccagggccagcgagctcccccggcagcaggtccccaagccatgtcaggcatctccaccacggctgggcgtctgtgccaggcctcccgaaggtggcgatggcgccagggacaccaggaattcgggggccccacgcaccacctacctggcttcctgcaaggccttcacgcctgccagggtcagctgcagcccccactctgccaagggcacttgcccgcctcccgccagcggtgggtggctgcgtctgaaggctgtcgtcggttacagcgggaatgggcgggccaacatggtctggaggccggacacaggcttctttgcctacacgtgcggccgct

SEQ ID NO: 279534 - DNA, 3884 bp, Homo sapiens
aatggcggaagtggcaccgttgccaggcagccgttgcctggcgtcgcggggcgtactctgcgctgggcgcgcggaggcctaggcgggaagctcgagcggcggcgccatggcccgaggtagcgcgcggctggcgggggtcccgaggatcccgggttccggggttccggggtccagggtcggcggccggagcgctcagggcccccgcctaggccctgaggccagagtccccgctcaggcagggtcccgtctgccgggcgcccaccctcgggctcccggagcttggcttccctcgggcgcccggcctcgtcccgccagcctagctggcgttggcgtcgccggggaaggcgcggagagccccggctcctgcctggtccccgaggcccggcccagccccgcagtggccccggctcgcgtggccgagtcccctgacgcccggcgcccgctccccgcagcgtggcagcacccgttcctcaacgtcttcagacacttccgggtggacgagtggaagcgctccgccaagcagggggacgtggccgtggtcacggacaagaccctgaagggcgccgtgtatcgcattcggggctcagtctctgccgccaactacatccagctccctaagagcagcacccagtctctggggctgacgggacgatacctgtatgtgctctttcggcccctgcccagcaagcacttcgtcatccacctcgatgtgtcctccaaggacaaccaagtcatccgtgtgtctttctccaacctcttcaaggagtttaagtctacggccacgtggctccagtttcccttggtcctggaggccaggacacctcagagagatctggtgggtttggccccctccggagcccgctggacctgcctgcagctcgatctgcaggacgttctcctggtctacctgaaccggtgctacggccatctcaagagcatcaggctgtgcgccagcctgctggtcaggaacctgtacaccagtgacctgtgctttgagcctgccatctctggggcccagtgggcaaagctgcccgtgactcctatgcctcgggaaatggcattccctgtgcccaagggagagagctggcatgaccgctacatccacgtccggtttccaagtgagagcttgaaagtgccttccaagccgattgagaagagctgttcccctcctgaggcagtcctcctggggccggggccacagcctctcccttgcccggtggcctccagcaaacctgtgcggttcagtgtgtctccagtggtccagacgcccagccccacagcccagtccggccgggccgccttggcacccaggcccttcccggaggtcagcctgtcccaagagcgctcagacgcctccaacgcggatggccccggtttccatagccttgagccctgggcccagctggaggcctctgacatccacacggctgctgccggcacccacgtgttgactcacgagtcggctgaggtgcccgtggcccgcaccggctcctgcgaaggcttcctcccagacccagtcctgaggctcaagggcgtcatcggctttgggggccacggcaccagacaggccctgtggaccccagacggggcggctgtcgtgtacccctgccatgcggtcatcgtcgtcctgctcgtggacacgggggagcagcgcttcttccttggccacacagacaaggtctccgccctggcgctggatggcagcagctcactattggcctcggcccaggcaagggcccctagtgtgatgcggctctgggacttccagaccgggcggtgcttgtgcctgttccggagcccaatgcacgttgtctgctctctcagcttctctgacagcggggcccttctctgcggggttggcaaggaccaccacgggaggacgatggtggtggcctggggcaccggccaggtgggcctcggtggcgaggtggtcgttctggcaaaggcgcacactgactttgacgtccaggccttccgggtcaccttttttgatgaaaccaggatggcgtcgtgcgggcagggcagtgtgcggctctggcggctgcgtggcggggtgctgcgttcctgccccgtggacttaggggagcaccacgcgctgcagttcaccgacctggccttcaagcaggcccgggacggctgcccggagccctcggctgccatgctcttcgtgtgcagccgcagtggccacatcttggagattgactgtcagcgcatggtcgtgcggcatgcccgccgcctgctccccacacggactccaggcggtccccacccacagaagcagaccttcagctcaggccccggcattgccatcagcagcctcagcgtctccccggccatgtgtgctgtgggctctgaggacggcttcttgcggctctggcccctggacttctcctcggtgctcctggaggcagagcacgagggccccgtcagctcagtctgtgtcagccccgatggcctccgtgtgctgtctgccacctcctcgggccacctgggcttcctggacacgctgtcccgggtgtaccacatgctggctcgctcccacaccgccccggtgttggccctcgccatggagcagaggcggggacagctggccaccgtgtcccaggaccgtaccgtccgcatctgggacctggccaccctgcagcagctatacgacttcacatcatcagaggacgccccgtgcgctgtcaccttccaccccacaaggccaacctttttctgtggctttagcagtggggccgtgcgctccttcagcctggaggccgctgaggtcctggtggaacacacgtgccaccgaggagctgtcaccggcctgaccgccacccctgacggccgcctgctcttcagctcctgctcccagggctccctggcccagtacagctgtgcggacccccagtggcatgtcctccgagtggcagcggacatggtatgcccggatgcccccgcgagccccagcgccctggcagtcagcagggatggccgcctgctggcctttgtgggaccctccaggtgcacagtgacagtcatgggctcggcctcccttgatgagctgctgcgagttgacatcggcactctggacctggccagcagccgcctggactcagccatggctgtgtgctttggccctgcagctctgggccacctgctggtgtccacctcgtccaacagagtcgtggtgctggatgctgtgtcgggccgcatcatccgggagctgcccggtgtccaccctgagccctgcccctccttgacgctcagtgaggacgcccgcttcctgctgattgccgccggccggaccatcaaggtgtgggactacgccacacaggccagcccaggcccccaggtgtacatcggccactcggaacccgtgcaggctgtggccttctctcctgaccagcagcaggtcctcagcgcaggggacgccgtcttcctctgggatgtcctggcccctactgagagcgaccaaagcttccccggggcccccccagcctgcaagacaggcccgggcgcaggaccgctggaggacgcagcgtccagggccagcgagctcccccggcagcaggtccccaagccatgtcaggcatctccaccacggctgggcgtctgtgccaggcctcccgaaggtggcgatggcgccagggacaccaggaattcgggggccccacgcaccacctacctggcttcctgcaaggccttcacgcctgccagggtcagctgcagcccccactctgccaagggcacttgcccgcctcccgccagcggtgggtggctgcgtctgaaggctgtcgtcggttacagcgggaatgggcgggccaacatggtctggaggccggacacaggtgggggccaagagcctacccccacccccagccaagatgcggccgcgc

SEQ ID NO: 279535 - DNA, 3780 bp, Homo sapiens
aatggcggaagtggcaccgttgccaggcagccgttgcctggcgtcgcggggcgtactctgcgctgggcgcgcggaggcctaggcgggaagctcgagcggcggcgccatggcccgaggtagcgcgcggctggcgggggtcccgaggatcccgggttccggggttccggggtccagggtcggcggccggagcgctcagggcccccgcctaggccctgaggccagagtccccgctcaggcagggtcccgtctgccgggcgcccaccctcgggctcccggagcttggcttccctcgggcgcccggcctcgtcccgccagcctagctggcgttggcgtcgccggggaaggcgcggagagccccggctcctgcctggtccccgaggcccggcccagccccgcagtggccccggctcgcgtggccgagtcccctgacgcccggcgcccgctccccgcagcgtggcagcacccgttcctcaacgtcttcagacacttccgggtggacgagtggaagcgctccgccaagcagggggacgtggccgtggtcacggacaagaccctgaagggcgccgtgtatcgcattcggggctcagtctctgccgccaactacatccagctccctaagagcagcacccagtctctggggctgacgggacgatacctgtatgtgctctttcggcccctgcccagcaagcacttcgtcatccacctcgatgtgtcctccaaggacaaccaagtcatccgtgtgtctttctccaacctcttcaaggagtttaagtctacggccacgtggctccagtttcccttggtcctggaggccaggacacctcagagagatctggtgggtttggccccctccggagcccgctggacctgcctgcagctcgatctgcaggacgttctcctggtctacctgaaccggtgctacggccatctcaagagcatcaggctgtgcgccagcctgctggtcaggaacctgtacaccagtgacctgtgctttgagcctgccatctctggggcccagtgggcaaagctgcccgtgactcctatgcctcgggaaatggcattccctgtgcccaagggagagagctggcatgaccgctacatccacgtccggtttccaagtgagagcttgaaagtgccttccaagccgattgagaagagctgttcccctcctgaggcagtcctcctggggccggggccacagcctctcccttgcccggtggcctccagcaaacctgtgcggttcagtgtgtctccagtggtccagacgcccagccccacagcccagtccggccgggccgccttggcacccaggcccttcccggaggtcagcctgtcccaagagcgctcagacgcctccaacgcggatggccccggtttccatagccttgagccctgggcccagctggaggcctctgacatccacacggctgctgccggcacccacgtgttgactcacgagtcggctgaggtgcccgtggcccgcaccggctcctgcgaaggcttcctcccagacccagtcctgaggctcaagggcgtcatcggctttgggggccacggcaccagacaggccctgtggaccccagacggggcggctgtcgtgtacccctgccatgcggtcatcgtcgtcctgctcgtggacacgggggagcagcgcttcttccttggccacacagacaaggtctccgccctggcgctggatggcagcagctcactattggcctcggcccaggcaagggcccctagtgtgatgcggctctgggacttccagaccgggcggtgcttgtgcctgttccggagcccaatgcacgttgtctgctctctcagcttctctgacagcggggcccttctctgcggggttggcaaggaccaccacgggaggacgatggtggtggcctggggcaccggccaggtgggcctcggtggcgaggtggtcgttctggcaaaggcgcacactgactttgacgtccaggccttccgggtcaccttttttgatgaaaccaggatggcgtcgtgcgggcagggcagtgtgcggctctggcggctgcgtggcggggtgctgcgttcctgccccgtggacttaggggagcaccacgcgctgcagttcaccgacctggccttcaagcaggcccgggacggctgcccggagccctcggctgccatgctcttcgtgtgcagccgcagtggccacatcttggagattgactgtcagcgcatggtcgtgcggcatgcccgccgcctgctccccacacggactccaggcggtccccacccacagaagcagaccttcagctcaggccccggcattgccatcagcagcctcagcgtctccccggccatgtgtgctgtgggctctgaggacggcttcttgcggctctggcccctggacttctcctcggtgctcctggaggcagagcacgagggccccgtcagctcagtctgtgtcagccccgatggcctccgtgtgctgtctgccacctcctcgggccacctgggcttcctggacacgctgtcccgggtgtaccacatgctggctcgctcccacaccgccccggtgttggccctcgccatggagcagaggcggggacagctggccaccgtgtcccaggaccgtaccgtccgcatctgggacctggccaccctgcagcagctatacgacttcacatcatcagaggacgccccgtgcgctgtcaccttccaccccacaaggccaacctttttctgtggctttagcagtggggccgtgcgctccttcagcctggaggccgctgaggtcctggtggaacacacgtgccaccgaggagctgtcaccggcctgaccgccacccctgacggccgcctgctcttcagctcctgctcccagggctccctggcccagtacagctgtgcggacccccagtggcatgtcctccgagtggcagcggacatggtatgcccggatgcccccgcgagccccagcgccctggcagtcagcagggatggccgcctgctggcctttgtgggaccctccaggtgcacagtgacagtcatgggctcggcctcccttgatgagctgctgcgagttgacatcggcactctggacctggccagcagccgcctggactcagccatggctgtgtgctttggccctgcagctctgggccacctgctggtgtccacctcgtccaacagagtcgtggtgctggatgctgtgtcgggccgcatcatccgggagctgcccggtgtccaccctgagccctgcccctccttgacgctcagtgaggacgcccgcttcctgctgattgccgccggccggaccatcaaggtgtgggactacgccacacaggccagcccaggcccccaggtgtacatcggccactcggaacccgtgcaggctgtggccttctctcctgaccagcagcaggtcctcagcgcaggggacgccgtcttcctctgggatgtcctggcccctactgagagcgaccaaagcttccccggggcccccccagcctgcaagacaggcccgggcgcaggaccgctggaggacgcagcgtccagggccagcgagctcccccggcagcaggtccccaagccatgtcaggcatctccaccacggctgggcgtctgtgccaggcctcccgaaggtggcgatgggcacttgcccgcctcccgccagcggtgggtggctgcgtctgaaggctgtcgtcggttacagcgggaatgggcgggccaacatggtctggaggccggacacaggtgggggccaagagcctacccccacccccagccaagatgcggccgcgc

SEQ ID NO: 279536 - DNA, 3720 bp, Homo sapiens
aatggcggaagtggcaccgttgccaggcagccgttgcctggcgtcgcggggcgtactctgcgctgggcgcgcggaggcctaggcgggaagctcgagcggcggcgccatggcccgaggtagcgcgcggctggcgggggtcccgaggatcccgggttccggggttccggggtccagggtcggcggccggagcgctcagggcccccgcctaggccctgaggccagagtccccgctcaggcagggtcccgtctgccgggcgcccaccctcgggctcccggagcttggcttccctcgggcgcccggcctcgtcccgccagcctagctggcgttggcgtcgccggggaaggcgcggagagccccggctcctgcctggtccccgaggcccggcccagccccgcagtggccccggctcgcgtggccgagtcccctgacgcccggcgcccgctccccgcagcgtggcagcacccgttcctcaacgtcttcagacacttccgggtggacgagtggaagcgctccgccaagcagggggacgtggccgtggtcacggacaagaccctgaagggcgccgtgtatcgcattcggggctcagtctctgccgccaactacatccagctccctaagagcagcacccagtctctggggctgacgggacgatacctgtatgtgctctttcggcccctgcccagcaagcacttcgtcatccacctcgatgtgtcctccaaggacaaccaagtcatccgtgtgtctttctccaacctcttcaaggagtttaagtctacggccacgtggctccagtttcccttggtcctggaggccaggacacctcagagagatctggtgggtttggccccctccggagcccgctggacctgcctgcagctcgatctgcaggacgttctcctggtctacctgaaccggtgctacggccatctcaagagcatcaggctgtgcgccagcctgctggtcaggaacctgtacaccagtgacctgtgctttgagcctgccatctctggggcccagtgggcaaagctgcccgtgactcctatgcctcgggaaatggcattccctgtgcccaagggagagagctggcatgaccgctacatccacgtccggtttccaagtgagagcttgaaagtgccttccaagccgattgagaagagctgttcccctcctgaggcagtcctcctggggccggggccacagcctctcccttgcccggtggcctccagcaaacctgtgcggttcagtgtgtctccagtggtccagacgcccagccccacagcccagtccggccgggccgccttggcacccaggcccttcccggaggtcagcctgtcccaagagcgctcagacgcctccaacgcggatggccccggtttccatagccttgagccctgggcccagctggaggcctctgacatccacacggctgctgccggcacccacgtgttgactcacgagtcggctgaggtgcccgtggcccgcaccggctcctgcgaaggcttcctcccagacccagtcctgaggctcaagggcgtcatcggctttgggggccacggcaccagacaggccctgtggaccccagacggggcggctgtcgtgtacccctgccatgcggtcatcgtcgtcctgctcgtggacacgggggagcagcgcttcttccttggccacacagacaaggtctccgccctggcgctggatggcagcagctcactattggcctcggcccaggcaagggcccctagtgtgatgcggctctgggacttccagaccgggcggtgcttgtgcctgttccggagcccaatgcacgttgtctgctctctcagcttctctgacagcggggcccttctctgcggggttggcaaggaccaccacgggaggacgatggtggtggcctggggcaccggccaggtgggcctcggtggcgaggtggtcgttctggcaaaggcgcacactgactttgacgtccaggccttccgggtcaccttttttgatgaaaccaggatggcgtcgtgcgggcagggcagtgtgcggctctggcggctgcgtggcggggtgctgcgttcctgccccgtggacttaggggagcaccacgcgctgcagttcaccgacctggccttcaagcaggcccgggacggctgcccggagccctcggctgccatgctcttcgtgtgcagccgcagtggccacatcttggagattgactgtcagcgcatggtcgtgcggcatgcccgccgcctgctccccacacggactccaggcggtccccacccacagaagcagaccttcagctcaggccccggcattgccatcagcagcctcagcgtctccccggccatgtgtgctgtgggctctgaggacggcttcttgcggctctggcccctggacttctcctcggtgctcctggaggcagagcacgagggccccgtcagctcagtctgtgtcagccccgatggcctccgtgtgctgtctgccacctcctcgggccacctgggcttcctggacacgctgtcccgggtgtaccacatgctggctcgctcccacaccgccccggtgttggccctcgccatggagcagaggcggggacagctggccaccgtgtcccaggaccgtaccgtccgcatctgggacctggccaccctgcagcagctatacgacttcacatcatcagaggacgccccgtgcgctgtcaccttccaccccacaaggccaacctttttctgtggctttagcagtggggccgtgcgctccttcagcctggaggccgctgaggtcctggtggaacacacgtgccaccgaggagctgtcaccggcctgaccgccacccctgacggccgcctgctcttcagctcctgctcccagggctccctggcccagtacagctgtgcggacccccagtggcatgtcctccgagtggcagcggacatggtatgcccggatgcccccgcgagccccagcgccctggcagtcagcagggatggccgcctgctggcctttgtgggaccctccaggtgcacagtgacagtcatgggctcggcctcccttgatgagctgctgcgagttgacatcggcactctggacctggccagcagccgcctggactcagccatggctgtgtgctttggccctgcagctctgggccacctgctggtgtccacctcgtccaacagagtcgtggtgctggatgctgtgtcgggccgcatcatccgggagctgcccggtgtccaccctgagccctgcccctccttgacgctcagtgaggacgcccgcttcctgctgattgccgccggccggaccatcaaggtgtacatcggccactcggaacccgtgcaggctgtggccttctctcctgaccagcagcaggtcctcagcgcaggggacgccgtcttcctctgggatgtcctggcccctactgagagcgaccaaagcttccccggggcccccccagcctgcaagacaggcccgggcgcaggaccgctggaggacgcagcgtccagggccagcgagctcccccggcagcaggtccccaagccatgtcaggcatctccaccacggctgggcgtctgtgccaggcctcccgaaggtggcgatgggcacttgcccgcctcccgccagcggtgggtggctgcgtctgaaggctgtcgtcggttacagcgggaatgggcgggccaacatggtctggaggccggacacaggcttctttgcctacacgtgcggccgct

SEQ ID NO: 279537 - DNA, 166 bp, Homo sapiens
ggtagaccaggggcttgtggggagactgcgtgtagtgtggggtctctgaagagctcagggcagtgtaatgccacaagctctgcctcctccctgccaggcgccagggacaccaggaattcgggggccccacgcaccacctacctggcttcctgcaaggccttcacgc

SEQ ID NO: 279538 - DNA, 876 bp, Homo sapiens
taaggctcagggaggggaggaaagttgcttgagggtccctctgggagctaggactggaacccacatttcctcccccgaccgccactgctgtaagagctccctggccttcagagacaagtggacgggggtgcttttctgcctcgctgcgtacaggagctgagccagttctaggcccaggcttctctttcctggcccctgactgactgaccctgatcctgtcccatttctcttgtcagccatgtgctctgggcacctcgcacgggctccgtagtcacattcccgggcctatccaatgcctgctccagggccagggacacagcttctggatctgaagcttgggctgaggtccagagacagctcagcattgtggtgacagccctggagggtgcggcagccaccctgaggcctgtggctgacctctgaccccagccctctttcttcagccctccctttactccaaccctctcctgcctgctttcctgagatgtcctggtcttccttggtgccagaagagggcactaccacaggaccctctcaagcttctcaggcaacagcttgaggtccctgaggggagtggcaagccctaatgcaactcaccctcatcctggtgcttaggtggcagagggtgggcagcaggggacagggatgggatggcaaaaccaccaactgcccttggtggcaggtgggtggagatgggatgcgtgccaacctcagatgccaactcaggtcatcaaggccaaggaccagtggcgaaagtgagtcttggggtaccttaggccttggctagtctgcgttcctctccctgcatgctgtgtatcctaactccctacaacagcccctcaaataaatcacatctagtgactggtaccaacaaaa

SEQ ID NO: 279539 - DNA, 2322 bp, Homo sapiens
accccagctggccaagagtccgcaggatgcagtggacgaaggtgttggggctggggctgggggctgctgccctcttggggctggggatcatcctcggccactttgccatccccaaaaaagccaactcactggccccccaggacctggacctggagatcctggagaccgtcatggggcagctggatgcccacaggatccgggagaacctcagagaactctccagggagccacacctggcctccagccctcgggatgaggacctggtgcagctgctgctgcagcgctggaaggacccagagtcaggcctggactcggccgaggcctccacgtacgaagtgctgctgtccttccctagccaggagcagcccaacgtcgtggacatcgtgggccccactgggggcatcatccactcctgccaccggactgaggagaacgtgaccggggagcaaggggggccagatgtggtacaaccctatgctgcctatgctccttctggaaccccacagggcctcctcgtctatgccaaccggggcgcggaagaagactttaaggagctacagactcagggcatcaaacttgaaggcaccattgccctgactcgatatgggggtgtagggcgtggggccaaggctgtgaacgctgccaagcacggggtagctggggtgctggtgtacacagaccctgccgacatcaacgatgggctgagctcacccgacgaaacctttcccaactcctggtacctgcccccctcaggagtggagcgaggctcctactacgagtattttggggaccctctgactccctaccttccagccgtcccctcttccttccgcgtggaccttgccaatgtctccggatttcccccaattcctacacagcccattggcttccaggatgcaagagacctgctctgtaacctcaacggaactttggccccagccacctggcagggagcactgggctgccactacaggttgggtcccggcttccggcctgacggagacttcccagcagacagccaggtgaatgtgagcgtctacaaccgcctggagctgaggaactcttccaacgtcctgggcatcatccgtggggctgtggagcctgatcgctacgtgctgtatgggaaccaccgagacagctgggtgcacggggctgtggaccccagcagtggcaccgccgtcctcctggagctctcccgtgtcctggggaccctgctgaagaagggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgccaacgctacccttagggtgcaggggacgccccctgtccagagcgtcgtcttctctgcaaccaaagagatccgctcaccaggccctggcgacctgagcatctacgacaactggatccggtacttcaaccgcagcagcccggtgtacggcctggtccccagcttgggttctctgggtgctggcagcgactatgcacccttcgttcacttcctgggcatctcctccatggacattgcctatacctatgaccggagcaagacttcagccaggatctaccccacctaccacacagcctttgacacctttgactatgtggacaagtttttggacccgggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggctccgtagtcacattcccgggcctatccaatgcctgctccagggccagggacacagcttctggatctgaagcttgggctgaggtccagagacagctcagcattgtggtgacagccctggagggtgcggcagccaccctgaggcctgtggctgacctctgaccccagccctctttcttcagccctcccggtgctttatatttacaaagtgctttgtgttttttaaaagtctttt

SEQ ID NO: 279540 - DNA, 1505 bp, Homo sapiens
gggctgctaccggtcggaagggctggggatgtactctctagatctgctggggctggactgaggctggggcaagcctcgtaaggactggaccacgggtgggcaggagaccggtggagaacccgccctgttgttggggctggggagggccgcgcaccgagactaaattctccttccggccagatccgctcaccaggccctggcgacctgagcatctacgacaactggatccggtacttcaaccgcagcagcccggtgtacggcctggtccccagagcaagacttcagccaggatctaccccacctaccacacagcctttgacacctttgactatgtggacaagtttttggacccgggtgaggagggagacaaggggcatcctgagaccaggacaggagaggctgaagactgagccctggccttgtcaccttgccgcaggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctgggtatgcacagccctgaccctgaggtatggggagccctgcacccccatgactgagccactgcttgttcctcacagggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggctccgtagtcacattcccgggcctatccaatgcctgctccagggccagggacacagcttctggatctgaagcttgggctgaggtccagagacagctcagcattgtggtgacagccctggagggtgcggcagccaccctgaggcctgtggctgacctctgaccccagccctctttcttcagccctccctttactccaaccctctcctgcctgctttcctgagatgtcctggtcttccttggtgccagaagagggcactaccacaggaccctctcaagcttctcaggcaacagcttgaggtccctgaggggagtggcaagccctaatgcaactcaccctcatcctggtgcttaggtggcagagggtgggcagcaggggacagggatgggatggcaaaaccaccaactgcccttggtggcaggtgggtggagatgggatgcgtgccaacctcagatgccaactcaggtcatcaaggccaaggaccagtggcgaaagtgagtcttggggtaccttaggccttggctagtctgcgttcctctccctgcatgctgtgtatcctaactccctacaacagcccctcaaataaatcacatctagtgactggtaccaacaaaa

SEQ ID NO: 279541 - DNA, 1663 bp, Homo sapiens
cccctcctcacgtcagcagcctttctcctaaggcaccctaggatcaggaggaccctgtcctccaaccctctatcccccattcccaggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgccaacgctacccttagggtgcaggggacgccccctgtccagagcgtcgtcttctctgcaaccaaagagatccgctcaccaggccctggcgacctgagcatctacgacaactggatccggtacttcaaccgcagcagcccggtgtacggcctggtccccagagcaagacttcagccaggatctaccccacctaccacacagcctttgacacctttgactatgtggacaagtttttggacccgggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggctccgtagtcacattcccgggcctatccaatgcctgctccagggccagggacacagcttctggatctgaagcttgggctgaggtccagagacagctcagcattgtggtgacagccctggagggtgcggcagccaccctgaggcctgtggctgacctctgaccccagccctctttcttcagccctccctttactccaaccctctcctgcctgctttcctgagatgtcctggtcttccttggtgccagaagagggcactaccacaggaccctctcaagcttctcaggcaacagcttgaggtccctgaggggagtggcaagccctaatgcaactcaccctcatcctggtgcttaggtggcagagggtgggcagcaggggacagggatgggatggcaaaaccaccaactgcccttggtggcaggtgggtggagatgggatgcgtgccaacctcagatgccaactcaggtcatcaaggccaaggaccagtggcgaaagtgagtcttggggtaccttaggccttggctagtctgcgttcctctccctgcatgctgtgtatcctaactccctacaacagcccctcaaataaatcacatctagtgactggtaccaacaaaaaaaaaaaaaaacaagaaaaaaaaaaaaaaaaacacacaataagaaagaacaaaaaccaaaagaaaaggaaaaaaaaaagaacaagaacgaagatgacaaagaaagaacgaaggggagcgcacaaaacaaaaaagaggcggaggacagaagaacgccaaaacacagaaaacagagaacagacgacacaagg

SEQ ID NO: 279542 - DNA, 954 bp, Homo sapiens
gggctgctaccggtcggaagggctggggatgtactctctagatctgctggggctggactgaggctggggcaagcctcgtaaggactggaccacgggtgggcaggagaccggtggagaacccgccctgttgttggggctggggagggccgcgcaccgagactaaattctccttccggccagatccgctcaccaggccctggcgacctgagcatctacgacaactggatccggtacttcaaccgcagcagcccggtgtacggcctggtccccagagcaagacttcagccaggatctaccccacctaccacacagcctttgacacctttgactatgtggacaagtttttggacccgggtgaggagggagacaaggggcatcctgagaccaggacaggagaggctgaagactgagccctggccttgtcaccttgccgcaggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctgggtatgcacagccctgaccctgaggtatggggagccctgcacccccatgactgagccactgcttgttcctcacagggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagtctgcgttcctctccctgcatgctgtgtatcctaactccctacaacagcccctcaaataaatcacatctagtgactggtaccaacaaaa

SEQ ID NO: 279543 - DNA, 1473 bp, Homo sapiens
cccctcctcacgtcagcagcctttctcctaaggcaccctaggatcaggaggaccctgtcctccaaccctctatcccccattcccaggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgccaacgctacccttagggtgcaggggacgccccctgtccagagcgtcgtcttctctgcaaccaaagagatccgctcaccaggccctggcgacctgagcatctacgacaactggatccggtacttcaaccgcagcagcccggtgtacggcctggtccccagagcaagacttcagccaggatctaccccacctaccacacagcctttgacacctttgactatgtggacaagtttttggacccgggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggctccgtagtcacattcccgggcctatccaatgcctgctccagggccagggacacagcttctggatctgaagcttgggctgaggtccagagacagctcagcattgtggtgacagccctggagggtgcggcagccaccctgaggcctgtggctgacctctgaccccagccctctttcttcagccctccctttactccaaccctctcctgcctgctttcctgagatgtcctggtcttccttggtgccagaagagggcactaccacaggaccctctcaagcttctcaggcaacagcttgaggtccctgaggggagtggcaagccctaatgcaactcaccctcatcctggtgcttaggtggcagagggtgggcagcaggggacagggatgggatggcaaaaccaccaactgcccttggtggcaggtgggtggagatgggatgcgtgccaacctcagatgccaactcaggtcatcaaggccaaggaccagtggcgaaagtgagtcttggggtaccttaggccttggctagtctgcgttcctctccctgcatgctgtgtatcctaactccctacaacagcccctcaaataaatcacatctagtgactggtaccaacaaaa

SEQ ID NO: 279544 - DNA, 1291 bp, Homo sapiens
gggctgctaccggtcggaagggctggggatgtactctctagatctgctggggctggactgaggctggggcaagcctcgtaaggactggaccacgggtgggcaggagaccggtggagaacccgccctgttgttggggctggggagggccgcgcaccgagactaaattctccttccggccagatccgctcaccaggccctggcgacctgagcatctacgacaactggatccggtacttcaaccgcagcagcccggtgtacggcctggtccccagagcaagacttcagccaggatctaccccacctaccacacagcctttgacacctttgactatgtggacaagtttttggacccgggtgaggagggagacaaggggcatcctgagaccaggacaggagaggctgaagactgagccctggccttgtcaccttgccgcaggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctgggtatgcacagccctgaccctgaggtatggggagccctgcacccccatgactgagccactgcttgttcctcacagggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagtttactccaaccctctcctgcctgctttcctgagatgtcctggtcttccttggtgccagaagagggcactaccacaggaccctctcaagcttctcaggcaacagcttgaggtccctgaggggagtggcaagccctaatgcaactcaccctcatcctggtgcttaggtggcagagggtgggcagcaggggacagggatgggatggcaaaaccaccaactgcccttggtggcaggtgggtggagatgggatgcgtgccaacctcagatgccaactcaggtcatcaaggccaaggaccagtggcgaaagtgagtcttggggtaccttaggccttggctagtctgcgttcctctccctgcatgctgtgtatcctaactccctacaacagcccctcaaataaatcacatctagtgactggtaccaacaaaa

SEQ ID NO: 279545 - DNA, 2083 bp, Homo sapiens
accccagctggccaagagtccgcaggatgcagtggacgaaggtgttggggctggggctgggggctgctgccctcttggggctggggatcatcctcggccactttgccatccccaaaaaagccaactcactggccccccaggacctggacctggagatcctggagaccgtcatggggcagctggatgcccacaggatccgggagaacctcagagaactctccagggagccacacctggcctccagccctcgggatgaggacctggtgcagctgctgctgcagcgctggaaggacccagagtcaggcctggactcggccgaggcctccacgtacgaagtgctgctgtccttccctagccaggagcagcccaacgtcgtggacatcgtgggccccactgggggcatcatccactcctgccaccggactgaggagaacgtgaccggggagcaaggggggccagatgtggtacaaccctatgctgcctatgctccttctggaaccccacagggcctcctcgtctatgccaaccggggcgcggaagaagactttaaggagctacagactcagggcatcaaacttgaaggcaccattgccctgactcgatatgggggtgtagggcgtggggccaaggctgtgaacgctgccaagcacggggtagctggggtgctggtgtacacagaccctgccgacatcaacgatgggctgagctcacccgacgaaacctttcccaactcctggtacctgcccccctcaggagtggagcgaggctcctactacgagtattttggggaccctctgactccctaccttccagccgtcccctcttccttccgcgtggaccttgccaatgtctccggatttcccccaattcctacacagcccattggcttccaggatgcaagagacctgctctgtaacctcaacggaactttggccccagccacctggcagggagcactgggctgccactacaggttgggtcccggcttccggcctgacggagacttcccagcagacagccaggtgaatgtgagcgtctacaaccgcctggagctgaggaactcttccaacgtcctgggcatcatccgtggggctgtggagcctgatcgctacgtgctgtatgggaaccaccgagacagctgggtgcacggggctgtggaccccagcagtggcaccgccgtcctcctggagctctcccgtgtcctggggaccctgctgaagaagggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgccaacgctacccttagggtgcaggggacgccccctgtccagagcgtcgtcttctctgcaaccaaagagatccgctcaccaggccctggcgacctgagcatctacgacaactggatccggtacttcaaccgcagcagcccggtgtacggcctggtccccaggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacaggtgggtggagatgggatgcgtgccaacctcagatgccaactcaggtcatcaaggccaaggaccagtggcgaaagtgagtcttggggtaccttaggccttggctagtctgcgttcctctccctgcatgctgtgtatcctaactccctacaacagcccctcaaataaatcacatctagtgactggtaccaacaaaa

SEQ ID NO: 279546 - DNA, 600 bp, Homo sapiens
caaagaaaagtcaacaaaggctctaacatcaacatgaccttggataaggtgtacatttcatcaggacagatgactcgaatggccaccaccaccgaggccttgcacacacctttgcagtgaacggcgatggccccttcggtgttctcacagatgttcaggaaccttcgcacgatgttgtcactgggtgtgctgccatctatgaagaagaggtcatagtgctcgaagccagcgtctgtgaagcgctttgcctcataaatctttttgtttagcctcacaactgcagtcacattatgctttttgaaataaggaaagtaggcttcaggggcgtgaagaggataacctaaaggaacaaaggagcagtaagcaaaaggcatgcatttcatcttccacaacccagaaatacaaaactctcaacaatgaagtgtataaatctcaacaaagcttgggaggaaagtgtgttgtgtgagagaagaggtcacagcaagctcctacaagcatcaatctgcataactgtaagcaccacaggaggttaaaaagaaaacttctgtaagtactgaaaatacatcattaaagttcaaaatctcaacctctagattcgaa

SEQ ID NO: 279547 - DNA, 3340 bp, Homo sapiens
agctcgccgagtagacggccccgccgcccgctgcccgccggggctctccagcttcgccatgccgccgtggggcgccgccctcgcgctcatcttggccgtgctcgcccttctcggcctgctcggcccgcggctccggggaccctgggggcgcgccgtcggagagaggaccctgccgggggcccaagaccgagacgacggggaggaggcggacggcggaggcccggcggaccagttcagcgacgggcgcgagccactgccgggagggtgcagccttgtttgcaagccgtcggccctggcccagtgcctgctgcgcgccctgcggcgctcagaggcgctggaggccggcccgcgctcctggttctccgggccccacctgcagaccctctgccacttcgtcctgcccgtagcgcctgggcctgagctggcccgggagtacctgcagttggcggacgatgggctagtggccctggactgggtggtaggaccttgtgttcggggccgccggatcaccagcgccgggggccttcctgcggtgcttctggtgatccccaatgcgtggggtcgcctcacccgcaacgtgctcggcctttgcttgctcgccctggagcgcggctactacccggtcatcttccatcgccgcggccaccacggttgcccactggtcagcccccggctgcagcctttcggggacccgtccgacctcaaggaggcggtcacatacatccgcttccgacacccggcggcgccgctgttcgcggtgagcgaaggctcgggctcggcgctgctcctgtcctacctgggcgagtgcggctcctccagctacgtgacaggcgccgcctgcatctcgcccgtgctgcgctgccgagagtggttcgaggccggcctgccctggccctacgagcggggctttctgctccaccagaagatcgccctcagcaggtatgccacagccctggaggacactgtggacaccagcagactgttcaggagccgttcccttcgagagtttgaggaggctctcttctgccacaccaaaagcttccccatcagctgggatgcctactgggaccgcaacgacccgctccgggatgtcgatgaggcagccgtgcctgtgctgtgtatctgcagtgctgacgaccccgtgtgtggacccccagaccacactctgacaactgaactcttccacagcaacccctacttcttcctcctgctcagtcgccacggaggccactgtggcttcctgcgccaggagcccttgccagcctggagccatgaggtcatcttggagtccttccgggccttgactgagttcttccgaacggaggagaggattaaagggctgagcaggcacagagcttccttccttgggggccgtcgtcgtgggggagccttgcagaggcgggaagtctcttcctcttccaacctggaggagatctttaactggaagcgatcatacacaaggtgaaagacctggcctgagaacccccaagtcctgcaaagaaaaacagagctgggcaagggggagtcctggaaagatggggcggactgaacagagggagctccagctctgtgctcctcattcagtccctctctcttaaattggtgccttgaaagagaaggaacgtcctgcgagcctgcactcacttcatcctcagcagaactcctgcctggcctctgctcaacatatccctactcatccggtcagcagcggcgcgttccagtcactgtcacctgtcactgacatcacaagccaaaggatagcactttttcaatccatggactcaggagaaaatgccctcttactggcagtggctagagggatgagacgtttgtgtatgtcactgggcagtgaccccgattctcaagctggagccatttgatgtcatgaggacaggatgtttgtgtctcggccccacttccctcatttgctctgtggttgtggcgccctgctttgaccgaatgctctggcaactgcggcagcaggcttgtgtgtgtgagaagggcggcagaggcagtggggctggctcgctgagggctgagcaggtagagaatgtgaatgtccatctcaaggaatgcgaagttccaatctctcagaggagctctgcaagtctcagctaggaatggggctgatctggcccccaagcctcactggagagatcccaagggtattttacaaataggaagcgctctcatgcaggatctgagggctttgctagaccatggttcaaggagtcagaatcttggctaccctacatgctccctctggcaccatttcaggggattactccagagagctgcagccagaactgtttatctcctgagatatggactttctctaagtcaggaaaagcacaaacctcataacttaggtgttttctggttggttgctcccttttctgatcctactactggcctctccctttccagagccaggagacacatctgggaccagaggaaacaaaagcaccaagaggttgactagagctgaccagtgatttacaaatatttcatattccaatgcttcgtctgctcaattattcaaaaggccatccctgtaaaggcagaaaagcttcctcttagatctggccactcagcaaataagtgggtatttggttttatgaagaataatgctgaggactagagatatagtatatcagagataatatatagtatacaggttgatctaaatattctggtttggattaggcaattaaaatttttttggcaacaggacatatgtttccatgtgttgctaagattcaaaaactttgccctgaagttttattttaatcgtcattgagaaagagggctcctgttctgacctcaaaaacagcaaagctgttgtaaagaagagagctgcttatacgaaaacccacattccaagacttggtataaggtattcctgaggccttgatttcaggtttggataatcttgccccagattctagatcttgttcttctagatcaaatcagaagaaactttgaaataactccaagaatctgcactgaaatgtagacagcactcgataatctaagggacattatcttgttgtgaaaaattatctccctcctggtgggattataggagtgagccatcgcacccggccggagctaaagttttgaaggtaaaatgatacttcattgaaacaataagacactcatgcatcaaaagtaagtctctagtccctctagtcttaccttgtaataatgcaataccttgccttagtatttagtatggttgaacaaaaaatttctctccaacttatttgtctctgaatagtaaatcagtctcccagtaacactggaatgttattattttttaaatctccagaaacaaata

SEQ ID NO: 279548 - DNA, 1904 bp, Homo sapiens
atctcacctgttgtatgatcgcgttccagattagagatctcctccaggttggaagaggaagagacttcccgcctctgcaaggctcccccacgacgacggcccccaaggaaggaagctctgtgctcctcattcagtccctctctcttaaattggtgccttgaaagagaaggaacgtcctgcgagcctgcactcacttcatcctcagcagaactcctgcctggcctctgctcaacatatccctactcatccggtcagcagcggcgcgttccagtcactgtcacctgtcactgacatcacaagccaaaggatagcactttttcaatccatggactcaggagaaaatgccctcttactggcagtggctagagggatgagacgtttgtgtatgtcactgggcagtgaccccgattctcaagctggagccatttgatgtcatgaggacaggatgtttgtgtctcggccccacttccctcatttgctctgtggttgtggcgccctgctttgaccgaatgctctggcaactgcggcagcaggcttgtgtgtgtgagaagggcggcagaggcagtggggctggctcgctgagggctgagcaggtagagaatgtgaatgtccatctcaaggaatgcgaagttccaatctctcagaggagctctgcaagtctcagctaggaatggggctgatctggcccccaagcctcactggagagatcccaagggtattttacaaataggaagcgctctcatgcaggatctgagggctttgctagaccatggttcaaggagtcagaatcttggctaccctacatgctccctctggcaccatttcaggggattactccagagagctgcagccagaactgtttatctcctgagatatggactttctctaagtcaggaaaagcacaaacctcataacttaggtgttttctggttggttgctcccttttctgatcctactactggcctctccctttccagagccaggagacacatctgggaccagaggaaacaaaagcaccaagaggttgactagagctgaccagtgatttacaaatatttcatattccaatgcttcgtctgctcaattattcaaaaggccatccctgtaaaggcagaaaagcttcctcttagatctggccactcagcaaataagtgggtatttggttttatgaagaataatgctgaggactagagatatagtatatcagagataatatatagtatacaggttgatctaaatattctggtttggattaggcaattaaaatttttttggcaacaggacatatgtttccatgtgttgctaagattcaaaaactttgccctgaagttttattttaatcgtcattgagaaagagggctcctgttctgacctcaaaaacagcaaagctgttgtaaagaagagagctgcttatacgaaaacccacattccaagacttggtataaggtattcctgaggccttgatttcaggtttggataatcttgccccagattctagatcttgttcttctagatcaaatcagaagaaactttgaaataactccaagaatctgcactgaaatgtagacagcactcgataatctaagggacattatcttgttgtgaaaaattatctccctcctggctgggagcggtggcacacacctataatctcagcactttgggaggccgaggtgggtggatcacgaggtcaggagatcgagaccatcctggctaacacagtgaaacctcatctctactaaaaatacaaaaaattagccgggcgtggtagcgggtgcctgtaatcccagttactcaggaggctgaggcaggagaatggcgtgaacccgggaggcggagcttgcagtgagctgagatcgcaccactgcactccagcctgggcgacagagtaagactgtgtttca

SEQ ID NO: 279549 - DNA, 1322 bp, Homo sapiens
tacggccatcgcaaagtttgtgcgtgtagggcgactctatagaatacccgccggatcgagcaaggagctctgcaagtctcagctaggaatggggctgatctggcccccaagcctcactggagagatcccaagggtattttacaaataggaagcgctctcatgcaggatctgagggctttgctagaccatggttcaaggagtcagaatcttggctaccctacatgctccctctggcaccatttcaggggattactccagagagctgcagccagaactgtttatctcctgagatatggactttctctaagtcaggaaaagcacaaacctcataacttaggtgttttctggttggttgctcccttttctgatcctactactggcctctccctttccagagccaggagacacatctgggaccagaggaaacaaaagcaccaagaggttgactagagctgaccagtgatttacaaatatttcatattccaatgcttcgtctgctcaattattcaaaaggccatccctgtaaaggcagaaaagcttcctcttagatctggccactcagcaaataagtgggtatttggttttatgaagaataatgctgaggactagagatatagtatatcagagataatatatagtatacaggttgatctaaatattctggtttggattaggcaattaaaatttttttggcaacaggacatatgtttccatgtgttgctaagattcaaaaactttgccctgaagttttattttaatcgtcattgagaaagagggctcctgttctgacctcaaaaacagcaaagctgttgtaaagaagagagctgcttatacgaaaacccacattccaagacttggtataaggtattcctgaggccttgatttcaggtttggataatcttgccccagattctagatcttgttcttctagatcaaatcagaagaaactttgaaataactccaagaatctgcactgaaatgtagacagcactcgataatctaagggacattatcttgttgtgaaaaattatctccctcctggctgggagcggtggcacacacctataatctcagcactttgggaggccgaggtgggtggatcacgaggtcaggagatcgagaccatcctggctaacacagtgaaacctcatctctactaaaaatacaaaaaattagccgggcgtggtagcgggtgcctgtaatcccagttactcaggaggctgaggcaggagaatggcgtgaacccgggaggcggagcttgcagtgagctgagatcgcaccactgcactccagcctgggcgacagagtaagactgtgtttca

SEQ ID NO: 279550 - DNA, 342 bp, Homo sapiens
tggtcagcccccggctgcagcctttcggggacccgtccgacctcaaggaggcggtcacatacatccgcttccgacacccggcggcgccgctgttcgcggtgagcgaaggctcgggctcggcgctgctcctgtcctacctgggcgagtgcggctcctccagctacgtgacaggcgccgcctgcatctcgcccgtgctgcgctgccgagagtggttcgaggccggcctgccctggccctacgagcggggctttctgctccaccagaagatcgccctcagcaggtgggtaacggaggccgcagaccagcatggaaagaatagagggcctgagctggctaagaatc

SEQ ID NO: 279551 - DNA, 3354 bp, Homo sapiens
agctcgccgagtagacggccccgccgcccgctgcccgccggggctctccagcttcgccatgccgccgtggggcgccgccctcgcgctcatcttggccgtgctcgcccttctcggcctgctcggcccgcggctccggggaccctgggggcgcgccgtcggagagaggaccctgccgggggcccaagaccgagacgacggggaggaggcggacggcggaggcccggcggaccagttcagcgacgggcgcgagccactgccgggagggtgcagccttgtttgcaagccgtcggccctggcccagtgcctgctgcgcgccctgcggcgctcagaggcgctggaggccggcccgcgctcctggttctccgggccccacctgcagaccctctgccacttcgtcctgcccgtagcgcctgggcctgagctggcccgggagtacctgcagttggcggacgatgggctagtggccctggactgggtggtaggaccttgtgttcggggccgccggatcaccagcgccgggggccttcctgcggtgcttctggtgatccccaatgcgtggggtcgcctcacccgcaacgtgctcggcctttgcttgctcgccctggagcgcggctactacccggtcatcttccatcgccgcggccaccacggttgcccactggtcagcccccggctgcagcctttcggggacccgtccgacctcaaggaggcggtcacatacatccgcttccgacacccggcggcgccgctgttcgcggtgagcgaaggctcgggctcggcgctgctcctgtcctacctgggcgagtgcggctcctccagctacgtgacaggcgccgcctgcatctcgcccgtgctgcgctgccgagagtggttcgaggccggcctgccctggccctacgagcggggctttctgctccaccagaagatcgccctcagcaggtatgccacagccctggaggacactgtggacaccagcagactgttcaggagccgttcccttcgagagtttgaggaggctctcttctgccacaccaaaagcttccccatcagctgggatgcctactgggaccgcaacgacccgctccgggatgtcgatgaggcagccgtgcctgtgctgtgtatctgcagtgctgacgaccccgtgtgtggacccccagaccacactctgacaactgaactcttccacagcaacccctacttcttcctcctgctcagtcgccacggaggccactgtggcttcctgcgccaggagcccttgccagcctggagccatgaggtcatcttggagtccttccgggccttgactgagttcttccgaacggaggagaggattaaagggctgagcaggcacagagcttccttccttgggggccgtcgtcgtgggggagccttgcagaggcgggaagtctcttcctcttccaacctggaggagatctttaactggaagcgatcatacacaaggtgaaagacctggcctgagaacccccaagtcctgcaaagaaaaacagagctgggcaagggggagtcctggaaagatggggcggactgaacagagggagctccagctctgtgctcctcattcagtccctctctcttaaattggtgccttgaaagagaaggaacgtcctgcgagcctgcactcacttcatcctcagcagaactcctgcctggcctctgctcaacatatccctactcatccggtcagcagcggcgcgttccagtcactgtcacctgtcactgacatcacaagccaaaggatagcactttttcaatccatggactcaggagaaaatgccctcttactggcagtggctagagggatgagacgtttgtgtatgtcactgggcagtgaccccgattctcaagctggagccatttgatgtcatgaggacaggatgtttgtgtctcggccccacttccctcatttgctctgtggttgtggcgccctgctttgaccgaatgctctggcaactgcggcagcaggcttgtgtgtgtgagaagggcggcagaggcagtggggctggctcgctgagggctgagcaggtagagaatgtgaatgtccatctcaaggaatgcgaagttccaatctctcagaggagctctgcaagtctcagctaggaatggggctgatctggcccccaagcctcactggagagatcccaagggtattttacaaataggaagcgctctcatgcaggatctgagggctttgctagaccatggttcaaggagtcagaatcttggctaccctacatgctccctctggcaccatttcaggggattactccagagagctgcagccagaactgtttatctcctgagatatggactttctctaagtcaggaaaagcacaaacctcataacttaggtgttttctggttggttgctcccttttctgatcctactactggcctctccctttccagagccaggagacacatctgggaccagaggaaacaaaagcaccaagaggttgactagagctgaccagtgatttacaaatatttcatattccaatgcttcgtctgctcaattattcaaaaggccatccctgtaaaggcagaaaagcttcctcttagatctggccactcagcaaataagtgggtatttggttttatgaagaataatgctgaggactagagatatagtatatcagagataatatatagtatacaggttgatctaaatattctggtttggattaggcaattaaaatttttttggcaacaggacatatgtttccatgtgttgctaagattcaaaaactttgccctgaagttttattttaatcgtcattgagaaagagggctcctgttctgacctcaaaaacagcaaagctgttgtaaagaagagagctgcttatacgaaaacccacattccaagacttggtataaggtattcctgaggccttgatttcaggtttggataatcttgccccagattctagatcttgttcttctagatcaaatcagaagaaactttgaaataactccaagaatctgcactgaaatgtagacagcactcgataatctaagggacattatcttgttgtgaaaaattatctccctcctggctgggagcggtggcacacacctataatctcagcactttgggaggccgaggtgggtggatcacgaggtcaggagatcgagaccatcctggctaacacagtgaaacctcatctctactaaaaatacaaaaaattagccgggcgtggtagcgggtgcctgtaatcccagttactcaggaggctgaggcaggagaatggcgtgaacccgggaggcggagcttgcagtgagctgagatcgcaccactgcactccagcctgggcgacagagtaagactgtgtttca

SEQ ID NO: 279552 - DNA, 2733 bp, Homo sapiens
agctcgccgagtagacggccccgccgcccgctgcccgccggggctctccagcttcgccatgccgccgtggggcgccgccctcgcgctcatcttggccgtgctcgcccttctcggcctgctcggcccgcggctccggggaccctgggggcgcgccgtcggagagaggaccctgccgggggcccaagaccgagacgacggggaggaggcggacggcggaggcccggcggaccagttcagcgacgggcgcgagccactgccgggagggtgcagccttgtttgcaagccgtcggccctggcccagtgcctgctgcgcgccctgcggcgctcagaggcgctggaggccggcccgcgctcctggttctccgggccccacctgcagaccctctgccacttcgtcctgcccgtagcgcctgggcctgagctggcccgggagtacctgcagttggcggacgatgggctagtggccctggactgggtggtaggaccttgtgttcggggccgccggatcaccagcgccgggggccttcctgcggtgcttctggtgatccccaatgcgtggggtcgcctcacccgcaacgtgctcggcctttgcttgctcgccctggagcgcggctactacccggtcatcttccatcgccgcggccaccacggttgcccactggtcagcccccggctgcagcctttcggggacccgtccgacctcaaggaggcggtcacatacatccgcttccgacacccggcggcgccgctgttcgcggtgagcgaaggctcgggctcggcgctgctcctgtcctacctgggcgagtgcggctcctccagctacgtgacaggcgccgcctgcatctcgcccgtgctgcgctgccgagagtggttcgaggccggcctgccctggccctacgagcggggctttctgctccaccagaagatcgccctcagcaggtatgccacagccctggaggacactgtggacaccagcagactgttcaggagccgttcccttcgagagtttgaggaggctctcttctgccacaccaaaagcttccccatcagctgggatgcctactgggaccgcaacgacccgctccgggatgtcgatgaggcagccgtgcctgtgctgtgtatctgcagtgctgacgaccccgtgtgtggacccccagaccacactctgacaactgaactcttccacagcaacccctacttcttcctcctgctcagtcgccacggaggccactgtggcttcctgcgccaggagcccttgccagcctggagccatgaggtcatcttggagtccttccgggccttgactgagttcttccgaacggaggagaggattaaagggctgagcaggcacagagcttccttccttgggggccgtcgtcgtgggggagccttgcagaggcgggaagtctcttcctcttccaacctggaggagatctttaactggaagcgatcatacacaaggtgaaagacctggcctgagaacccccaagtcctgcaaagaaaaacagagctgggcaagggggagtcctggaaagatggggcggactgaacagagggagctccagctctgtgctcctcattcagtccctctctcttaaattggtgccttgaaagagaaggaacgtcctgcgagcctgcactcacttcatcctcagcagaactcctgcctggcctctgctcaacatatccctactcatccggtcagcagcggcgcgttccagtcactgtcacctgtcactgacatcacaagccaaaggatagcactttttcaatccatggactcaggagaaaatgccctcttactggcagtggctagagggatgagacgtttgtgtatgtcactgggcagtgaccccgattctcaagctggagccatttgatgtcatgaggacaggatgtttgtgtctcggccccacttccctcatttgctctgtggttgtggcgccctgctttgaccgaatgctctggcaactgcggcagcaggcttgtgtgtgtgagaagggcggcagaggcagtggggctggctcgctgagggctgagcaggtagagaatgtgaatgtccatctcaaggaatgcgaagttccaatctctcagaggagctctgcaagtctcagctaggaatggggctgatctggcccccaagcctcactggagagatcccaagggtattttacaaataggaagcgctctcatgcaggatctgagggctttgctagaccatggttcaaggagtcagaatcttggctaccctacatgctccctctggcaccatttcaggggattactccagagagctgcagccagaactgtttatctcctgagatatggactttctctaagtcaggaaaagcacaaacctcataacttaggtgttttctggttggttgctcccttttctgatcctactactggcctctccctttccagagccaggagacacatctgggaccagaggaaacaaaagcaccaagaggttgactagagctgaccagtgatttacaaatatttcatattccaatgcttcgtctgctcaattattcaaaaggccatccctgtaaaggcagaaaagcttcctcttagatctggccactcagcaaataagtgggtatttggttttatgaagaataatgctgaggactagagatatagtatatcagagataatatatagtatacaggttgatctaaatattctggtttggattaggcaattaaaatttttttggcaacagga

SEQ ID NO: 279553 - DNA, 2709 bp, Homo sapiens
agctcgccgagtagacggccccgccgcccgctgcccgccggggctctccagcttcgccatgccgccgtggggcgccgccctcgcgctcatcttggccgtgctcgcccttctcggcctgctcggcccgcggctccggggaccctgggggcgcgccgtcggagagaggaccctgccgggggcccaagaccgagacgacggggaggaggcggacggcggaggcccggcggaccagttcagcgacgggcgcgagccactgccgggagggtgcagccttgtttgcaagccgtcggccctggcccagtgcctgctgcgcgccctgcggcgctcagaggcgctggaggccggcccgcgctcctggttctccgggccccacctgcagaccctctgccacttcgtcctgcccgtagcgcctgggcctgagctggcccgggagtacctgcagttggcggacgatgggctagtggccctggactgggtggtaggaccttgtgttcggggccgccggatcaccagcgccgggggccttcctgcggtgcttctggtgatccccaatgcgtggggtcgcctcacccgcaacgtgctcggcctttgcttgctcgccctggagcgcggctactacccggtcatcttccatcgccgcggccaccacggttgcccactggtcagcccccggctgcagcctttcggggacccgtccgacctcaaggaggcggtcacatacatccgcttccgacacccggcggcgccgctgttcgcggtgagcgaaggctcgggctcggcgctgctcctgtcctacctgggcgagtgcggctcctccagctacgtgacaggcgccgcctgcatctcgcccgtgctgcgctgccgagagtggttcgaggccggcctgccctggccctacgagcggggctttctgctccaccagaagatcgccctcagcaggtatgccacagccctggaggacactgtggacaccagcagactgttcaggagccgttcccttcgagagtttgaggaggctctcttctgccacaccaaaagcttccccatcagctgggatgcctactgggaccgcaacgacccgctccgggatgtcgatgaggcagccgtgcctgtgctgtgtatctgcagtgctgacgaccccgtgtgtggacccccagaccacactctgacaactgaactcttccacagcaacccctacttcttcctcctgctcagtcgccacggaggccactgtggcttcctgcgccaggagcccttgccagcctggagccatgaggtcatcttggagtccttccgggccttgactgagttcttccgaacggaggagaggattaaagggctgagcaggcacagagcttccttccttgggggccgtcgtcgtgggggagccttgcagaggcgggaagtctcttcctcttccaacctggaggagatctttaactggaagcgatcatacacaaggtgaaagacctggcctgagaacccccaagtcctgcaaagaaaaacagagctgggcaagggggagtcctggaaagatggggcggactgaacagagggagctccagctctgtgctcctcattcagtccctctctcttaaattggtgccttgaaagagaaggaacgtcctgcgagcctgcactcacttcatcctcagcagaactcctgcctggcctctgctcaacatatccctactcatccggtcagcagcggcgcgttccagtcactgtcacctgtcactgacatcacaagccaaaggatagcactttttcaatccatggactcaggagaaaatgccctcttactggcagtggctagagggatgagacgtttgtgtatgtcactgggcagtgaccccgattctcaagctggagccatttgatgtcatgaggacaggatgtttgtgtctcggccccacttccctcatttgctctgtggttgtggcgccctgctttgaccgaatgctctggcaactgcggcagcaggcttgtgtgtgtgagaagggcggcagaggcagtggggctggctcgctgagggctgagcaggtagagaatgtgaatgtccatctcaaggaatgcgaagttccaatctctcagaggagctctgcaagtctcagctaggaatggggctgatctggcccccaagcctcactggagagatcccaagggtattttacaaataggaagcgctctcatgcaggatctgagggctttgctagaccatggttcaaggagtcagaatcttggctaccctacatgctccctctggcaccatttcaggggattactccagagagctgcagccagaactgtttatctcctgagatatggactttctctaagtcaggaaaagcacaaacctcataacttaggtgttttctggttggttgctcccttttctgatcctactactggcctctccctttccagagccaggagacacatctgggaccagaggaaacaaaagcaccaagaggttgactagagctgaccagtgatttacaaatatttcatattccaatgcttcgtctgctcaattattcaaaaggccatccctgtaaaggcagaaaagcttcctcttagatctggccactcagcaaataataatgctgaggactagagatatagtatatcagagataatatatagtatacaggttgatctaaatattctggtttggattaggcaattaaaatttttttggcaacagga

SEQ ID NO: 279554 - DNA, 1067 bp, Homo sapiens
agggccgcagggagtgcgcatgcggccgagtgcgggactggggctcctggctgtgggtgtggtactgaggcttcagcgggtgccgcccgcctagagggagtggagcgagagcctacgactagatttgcatctttacgtcctgcgcggaggctgctacacacatgcagaagtcatgctggtggcctggacattgaagggagagaagtggatttgggagacatttaggagatggcaccgaaagcgaaggaagctcctgctcctcctaaagccgaagccaaagcgaaggctttaaaggccaagaaggcagtgttgaaaggtgtccgcagccacacgcaaaaaagaggatccgcatgtcactcaccttcaggcggcccaagacactgcgactccggaggcagcccagatatcctcagaagagcacccccaggagaaacaagcttggccactatgctatcatcaagtttccgctgaccactgagtcggccgtgaagaagatagaagaaaacaacacgcttgtgttcactgtggatgttaaagccaacaagcaccagatcagacaggctgtgaagaagctctatgacagtgatgtggccaaggtcaccaccctgatttgtcctgataaagagaagaaggcatatgttcgacttgctcctgattatgatgctttcaatgttgtaacaaaattgggatcacctaaactgagtccagctggctaactctaaatatatgtgtatcttttcagcataaaaaaataatgtttttcataagaatgacaacttaattagaatcaaatctataagctttaagattttacgtttctagtaagtataatattagcttatttgactagaactcaagcagaataggaatttatgcttgttttatattcaataatgataattttgaagatatagttgttttattacaccaaaaatactatattaatcttatttaactaagttttatccaaatcatgttaacttaagaaacatttgatcagttcctatatttctaggagtttggtgaatatttatttataaatgcttatttttttccaagccaagtta

SEQ ID NO: 279555 - DNA, 1318 bp, Homo sapiens
agggccgcagggagtgcgcatgcggccgagtgcgggactggggctcctggctgtgggtgtggtactgaggcttcagcgggtgccgcccgcctagagggagtggagcggtgagcacgtcaggggtggggggcgcaggtcaagctttcaccagtttttaattctttgatggggtaaatttgagcaattttctcgacttgtcgacattcgttattaactgagcaggaatcaggagaggaacccggtcctctccacacagcccagcagggagacaggagacatcaatatatgtaagatgaacgttggttccctcgggaaaggcgggacaactcgaagcagggagggggcttccaggtcacagagagcctacgactagatttgcatctttacgtcctgcgcggaggctgctacacacatgcagaagtcatgctggtggcctggacattgaagggagagaagtggatttgggagacatttaggagatggcaccgaaagcgaaggaagctcctgctcctcctaaagccgaagccaaagcgaaggctttaaaggccaagaaggcagtgttgaaaggtgtccgcagccacacgcaaaaaagaggatccgcatgtcactcaccttcaggcggcccaagacactgcgactccggaggcagcccagatatcctcagaagagcacccccaggagaaacaagcttggccactatgctatcatcaagtttccgctgaccactgagtcggccgtgaagaagatagaagaaaacaacacgcttgtgttcactgtggatgttaaagccaacaagcaccagatcagacaggctgtgaagaagctctatgacagtgatgtggccaaggtcaccaccctgatttgtcctgataaagagaagaaggcatatgttcgacttgctcctgattatgatgctttcaatgttgtaacaaaattgggatcacctaaactgagtccagctggctaactctaaatatatgtgtatcttttcagcataaaaaaataatgtttttcataagaatgacaacttaattagaatcaaatctataagctttaagattttacgtttctagtaagtataatattagcttatttgactagaactcaagcagaataggaatttatgcttgttttatattcaataatgataattttgaagatatagttgttttattacaccaaaaatactatattaatcttatttaactaagttttatccaaatcatgttaacttaagaaacatttgatcagttcctatatttctaggagtttggtgaatatttatttataaatgcttatttttttccaagccaagtta

SEQ ID NO: 279556 - DNA, 1627 bp, Homo sapiens
agggccgcagggagtgcgcatgcggccgagtgcgggactggggctcctggctgtgggtgtggtactgaggcttcagcgggtgccgcccgcctagagggagtggagcggtgagcacgtcaggggtggggggcgcaggtcaagctttcaccagtttttaattctttgatggggtaaatttgagcaattttctcgacttgtcgacattcgttattaactgagcaggaatcaggagaggaacccggtcctctccacacagcccagcaggtacgccgcccatgtgcctgtggagaagagaggttcctgtggggcagacaggtgtggaccaagtagctgtgaaatttcttctgaagaaaacacacaaggaggaagcgagtgagctcagtggaggaggggcgctaccccaggggacgtccccatgcatgggcttgtgaacctcgaatatgtgagacggtctcagtcaatttagaaagtttattttgccaaggttgaggacgcacgcccgtgacacagcctcaggaggtcttgacatgtgccaaaggtggtcgggacacagcttgcttttatacattttagggagacaggagacatcaatatatgtaagatgaacgttggttccctcgggaaaggcgggacaactcgaagcagggagggggcttccaggtcacagagagcctacgactagatttgcatctttacgtcctgcgcggaggctgctacacacatgcagaagtcatgctggtggcctggacattgaagggagagaagtggatttgggagacatttaggagatggcaccgaaagcgaaggaagctcctgctcctcctaaagccgaagccaaagcgaaggctttaaaggccaagaaggcagtgttgaaaggtgtccgcagccacacgcaaaaaagaggatccgcatgtcactcaccttcaggcggcccaagacactgcgactccggaggcagcccagatatcctcagaagagcacccccaggagaaacaagcttggccactatgctatcatcaagtttccgctgaccactgagtcggccgtgaagaagatagaagaaaacaacacgcttgtgttcactgtggatgttaaagccaacaagcaccagatcagacaggctgtgaagaagctctatgacagtgatgtggccaaggtcaccaccctgatttgtcctgataaagagaagaaggcatatgttcgacttgctcctgattatgatgctttcaatgttgtaacaaaattgggatcacctaaactgagtccagctggctaactctaaatatatgtgtatcttttcagcataaaaaaataatgtttttcataagaatgacaacttaattagaatcaaatctataagctttaagattttacgtttctagtaagtataatattagcttatttgactagaactcaagcagaataggaatttatgcttgttttatattcaataatgataattttgaagatatagttgttttattacaccaaaaatactatattaatcttatttaactaagttttatccaaatcatgttaacttaagaaacatttgatcagttcctatatttctaggagtttggtgaatatttatttataaatgcttatttttttccaagccaagtta

SEQ ID NO: 279557 - DNA, 730 bp, Homo sapiens
agggccgcagggagtgcgcatgcggccgagtgcgggactggggctcctggctgtgggtgtggtactgaggcttcagcgggtgccgcccgcctagagggagtggagcggtgagcacgtcaggggtggggggcgcaggtcaagctttcaccagtttttaattctttgatggggtaaatttgagcaattttctcgacttgtcgacattcgttattaactgagcaggaatcaggagaggaacccggtcctctccacacagcccagcagagagcctacgactagatttgcatctttacgtcctgcgcggaggctgctacacacatgcagaagtcatgctggtggcctggacattgaagggagagaagtggatttgggagacatttaggaggaacagtaagaggaccttgtgcatgaataatttgtttccacactacagaaaagaatcccagtcttcttagagaacccagtgactttttgcaccttaaatctgtgaaatcctcatgttttcttctgccgtatccatagttcaaacaaagatgaggcaaagctagatgcattcctgaaggaacccaagaaattcctctctttatttctctggaatgaaatgaattctctagacgaccagttctaaccttcaaaaaccaaacctgtttgtgagatctccttcaaatactactgtagaccccagtgtttattcattaaattttaaaatatttgttttatttggaatcca

SEQ ID NO: 279558 - DNA, 1084 bp, Homo sapiens
agggccgcagggagtgcgcatgcggccgagtgcgggactggggctcctggctgtgggtgtggtactgaggcttcagcgggtgccgcccgcctagagggagtggagcggtgagcacgtcaggggtggggggcgcaggtcaagctttcaccagtttttaattctttgatggggtaaatttgagcaattttctcgacttgtcgacattcgttattaactgagcaggaatcaggagaggaacccggtcctctccacacagcccagcaggtacgccgcccatgtgcctgtggagaagagaggttcctgtggggcagacaggtgtggaccaagtagctgtgaaatttcttctgaagaaaacacacaaggaggaagcgagtgagctcagtggaggaggggcgctaccccaggggacgtccccatgcatgggcttgtgaacctcgaatatgtgagacggtctcagtcaatttagaaagtttattttgccaaggttgaggacgcacgcccgtgacacagcctcaggaggtcttgacatgtgccaaaggtggtcgggacacagcttgcttttatacattttagggagacaggagacatcaatatatgtaagatgaacgttggttccctcgggaaaggcgggacaactcgaagcagggagggggcttccaggtcacagagagcctacgactagatttgcatctttacgtcctgcgcggaggctgctacacacatgcagaagtcatgctggtggcctggacattgaagggagagaagtggatttgggagacatttaggagaaagaatcccagtcttcttagagaacccagtgactttttgcaccttaaatctgtgaaatcctcatgttttcttctgccgtatccatagttcaaacaaagatgaggcaaagctagatgcattcctgaaggaacccaagaaattcctctctttatttctctggaatgaaatgaattctctagacgaccagttctaaccttcaaaaaccaaacctgtttgtgagatctccttcaaatactactgtagaccccagtgtttattcattaaattttaaaatatttgttttatttggaatcca

SEQ ID NO: 279559 - DNA, 1224 bp, Homo sapiens
agggccgcagggagtgcgcatgcggccgagtgcgggactggggctcctggctgtgggtgtggtactgaggcttcagcgggtgccgcccgcctagagggagtggagcggtgagcacgtcaggggtggggggcgcaggtcaagctttcaccagtttttaattctttgatggggtaaatttgagcaattttctcgacttgtcgacattcgttattaactgagcaggaatcaggagaggaacccggtcctctccacacagcccagcagagagcctacgactagatttgcatctttacgtcctgcgcggaggctgctacacacatgcagaagtcatgctggtggcctggacattgaagggagagaagtggatttgggagacatttaggagatggcaccgaaagcgaaggaagctcctgctcctcctaaagccgaagccaaagcgaaggctttaaaggccaagaaggcagtgttgaaaggtgtccgcagccacacgcaaaaaagaggatccgcatgtcactcaccttcaggcggcccaagacactgcgactccggaggcagcccagatatcctcagaagagcacccccaggagaaacaagcttggccactatgctatcatcaagtttccgctgaccactgagtcggccgtgaagaagatagaagaaaacaacacgcttgtgttcactgtggatgttaaagccaacaagcaccagatcagacaggctgtgaagaagctctatgacagtgatgtggccaaggtcaccaccctgatttgtcctgataaagagaagaaggcatatgttcgacttgctcctgattatgatgctttcaatgttgtaacaaaattgggatcacctaaactgagtccagctggctaactctaaatatatgtgtatcttttcagcataaaaaaataatgtttttcataagaatgacaacttaattagaatcaaatctataagctttaagattttacgtttctagtaagtataatattagcttatttgactagaactcaagcagaataggaatttatgcttgttttatattcaataatgataattttgaagatatagttgttttattacaccaaaaatactatattaatcttatttaactaagttttatccaaatcatgttaacttaagaaacatttgatcagttcctatatttctaggagtttggtgaatatttatttataaatgcttatttttttccaagccaagtta

SEQ ID NO: 279560 - DNA, 524 bp, Homo sapiens
agggccgcagggagtgcgcatgcggccgagtgcgggactggggctcctggctgtgggtgtggtactgaggcttcagcgggtgccgcccgcctagagggagtggagcgagagcctacgactagatttgcatctttacgtcctgcgcggaggctgctacacacatgcagaagtcatgctggtggcctggacattgaagggagagaagtggatttgggagacatttaggagaaagaatcccagtcttcttagagaacccagtgactttttgcaccttaaatctgtgaaatcctcatgttttcttctgccgtatccatagttcaaacaaagatgaggcaaagctagatgcattcctgaaggaacccaagaaattcctctctttatttctctggaatgaaatgaattctctagacgaccagttctaaccttcaaaaaccaaacctgtttgtgagatctccttcaaatactactgtagaccccagtgtttattcattaaattttaaaatatttgttttatttggaatcca

SEQ ID NO: 279561 - DNA, 667 bp, Homo sapiens
agggccgcagggagtgcgcatgcggccgagtgcgggactggggctcctggctgtgggtgtggtactgaggcttcagcgggtgccgcccgcctagagggagtggagcgggagacaggagacatcaatatatgtaagatgaacgttggttccctcgggaaaggcgggacaactcgaagcagggagggggcttccaggtcacagagagcctacgactagatttgcatctttacgtcctgcgcggaggctgctacacacatgcagaagtcatgctggtggcctggacattgaagggagagaagtggatttgggagacatttaggaggaacagtaagaggaccttgtgcatgaataatttgtttccacactacagaaaagaatcccagtcttcttagagaacccagtgactttttgcaccttaaatctgtgaaatcctcatgttttcttctgccgtatccatagttcaaacaaagatgaggcaaagctagatgcattcctgaaggaacccaagaaattcctctctttatttctctggaatgaaatgaattctctagacgaccagttctaaccttcaaaaaccaaacctgtttgtgagatctccttcaaatactactgtagaccccagtgtttattcattaaattttaaaatatttgttttatttggaatcca

SEQ ID NO: 279562 - DNA, 922 bp, Homo sapiens
ggggcgatcagaagcaggtcacacagcctgtttcctgttttcaaacggggaacttagaaagtggcagcccctcggcttgtcgccggagctgagaaccaagagctcgaaggggccatatgacactcctcccggacccctggacacacacagccctggagactggagccttggagcatggcaagtccagagcaccctgggagccctggctgcatgggacccataacccagtgcacggcaaggacccagcaggaagcaccagccactggccccgacctcccgcacccaggacctgacgggcacttagacacacacagtggcctgagctccaactccagcatgaccacgcgggagcttcagcagtactggcagaaccagaaatgccgctggaagcacgtcaaactgctctttgagatcgcttcagctcgcatcgaggagagaaaagtctctaagtttgtgatggggaaatcaaggcctggagagatgacttatccagggtcacgtggcgagacagggacagcaccagaaccagacccgagatgtccacgtcaaagtgacatgctctgagaggcagcacacacagaataaccctgcatccaaattccaggaagctcttaggggtcatccagctgggcctaggggtgcagggtcagtgctgaggcctgggcagggccgctagcctccctgagctttctggcttcaggctgggaggcacagttcagggtggactgtgaccccttggcctagaatgcccttagctctgctctctagtggctgtccccatagctggaactctgttttggagtggcaaaaccagttccacctgctggtaggggtaggttggctcccaacacatccccagcaggcctctcttgggctcaaaagccaagctgtgcccagccacgtctccaaatgcttcctggcc

SEQ ID NO: 279563 - DNA, 1355 bp, Homo sapiens
ggggcgatcagaagcaggtcacacagcctgtttcctgttttcaaacggggaacttagaaagtggcagcccctcggcttgtcgccggagctgagaaccaagagctcgaaggggccatatgacactcctcccggacccctggacacacacagccctggagactggagccttggagcatggcaagtccagagcaccctgggagccctggctgcatgggacccataacccagtgcacggcaaggacccagcaggaagcaccagccactggccccgacctcccgcacccaggacctgacgggcacttagacacacacagtggcctgagctccaactccagcatgaccacgcgggagcttcagcagtactggcagaaccagaaatgccgctggaagcacgtcaaactgctctttgagatcgcttcagctcgcatcgaggagagaaaagtctctaagtttgtggtgtaccaaatcatcgtcatccagactgggagctttgacaacaacaaggccgtcctggaacggcgctattccgacttcgcgaagctccagaaagcgctgctgaagacgttcagggaggagatcgaagacgtggagtttcccaggaagcacctgactgggaacttcgctgaggagatgatctgtgagcgtcggcgcgccctgcaggagtacctgggcctgctctacgccatccgctgcgtgcgccgctcccgggagttcctggacttcctcacgcggccggagctgcgcgaggctttcggctgcctgcgggccggccagtacccgcgcgccctggagctgctgctgcgcgtgctgccgctgcaggagaagctcaccgcccactgccctgcggccgccgtcccggccctgtgcgccgtgctgctgtgccaccgcgacctcgaccgccccgccgaggccttcgcggccggagagagggccctgcagcgcctgcaggcccgggagggccatcgctactatgcgcctctgctggacgccatggtccgcctggcctacgcgctgggcaaggacttcgtgactctgcaggagaggctggaggagagccagctccggaggcccacgccccgaggcatcaccctgaaggagctcactgtgcgagaatacctgcactgagccggcctgggaccccgcagggacgctggagatttggggtcaccatggctcacagtgggctgtttggggttctttttttttatttttccttttcttttttgttatttgagacagtcttgctctgtcacccagactgaagtgcagtggctcaattatgtctcactgcagcctcaaactcctgggcacaagcaatcctcccctcgtgcgaattcttgggctcgagggcaaaa

SEQ ID NO: 279564 - DNA, 897 bp, Homo sapiens
ggggcgatcagaagcaggtcacacagcctgtttcctgttttcaaacggggaacttagaaagtggcagcccctcggcttgtcgccggagctgagaaccaagagctcgaaggggccatatgacactcctcccggacccctggacacacacagccctggagactggagccttggagcatggcaagtccagagcaccctgggagccctggctgcatgggacccataacccagtgcacggcaaggacccagcaggaagcaccagccactggccccgacctcccgcacccaggacctgacgggcacttagacacacacagtggcctgagctccaactccagcatgaccacgcgggagcttcagcagtactggcagaaccagaaatgccgctggaagcacgtcaaactgctctttgagatcgcttcagctcgcatcgaggagagaaaagtctctaagtttgtggctccggctcctgacgccacaccctgatatcaagaccctcagatggagcgagcgttctgggctggtcgaagcctgaagccgcagtatgtccttgagtgggtccccccctacccatctagctgttgcccccatggtaagatcaagaaaatgccctcccctccaaaagtccccacgccgagccctcatctgtcagctcccaggctcggccccctcactagctccaggctgggaggcacagttcagggcagactgtggcccctcagcatagcatggacttagctctgctctctagtggctgtccccatagctagaactctgttttggagcagcaaaactagttccacctgctggtagggctaagttgactcccaacatgtccccagcgtgttggtgttgggaaccttgatctagctgctcgttttctcagtaaccaaagatccc

SEQ ID NO: 279565 - DNA, 484 bp, Homo sapiens
tcagggcatgctttacaccggcctggttaactttactctgggtgtgctccgtccgccgcagcccccgccgggaggtggccacagctctctctggttgcgccctaggtgtaccaaatcatcgtcatccagactgggagctttgacaacaacaaggccgtcctggaacggcgctattccgacttcgcgaagctccagaaagcgctgctgaagacgttcagggaggagatcgaagacgtggagtttcccaggaagcacctgactgggaacttcgctgaggagatgatctgtgagcgtcggcgcgccctgcaggagtacctgggcctgctctacgccatccgctgcgtgcgccgctcccgggagttcctggacttcctcacgcggccggagctgcgcgaggctttcggctgcctgcgggccggccagtacccgcgcgccctggagctgctgctgcgcgtgctgccgctgcaggagaagctcaccgccc

SEQ ID NO: 279566 - DNA, 892 bp, Homo sapiens
ccgcctcccgaggccccgggtgagaaacgggggagacgcgaggggcggagcttgtggaggaagatggctgccgcctgggggtcgtccctaacggccgcgacgcagagagcggtcactccctggccgaggggcaggctcctcacggcctccctgggaccccaggcgcgtcgggaggcgtcgtcctccagccccgaggccggcgaagggcagatccgcctcacagacagttgcgtccagaggcttttggaaatcaccgaagggtcagaattcctcaggctgcaagtggagggaggtggatgctccggattccaatacaaattttcactggatacagttatcaaccccgacgacagggtatttgaacagggtggggcaagagtggtggttgactctgatagcttggccttcgtgaaaggggcccaggtggacttcagccaagaactgatccgaagctcatttcaagtgttgaacaatcctcaagcacagcaaggctgctcctgtgggtcatctttctctatcaaactttgatgtgatgactggtgactctgggattgtcaccagttgtaccaatttgaagaacctggaattagtagaattctagaagtttacttctaatcatgtccctctcaattttatttcccgcagtccaggagtgttatgttttgccactattattttcagaatgtgaagattttactcttggcttaatttttccctccactcagtgctaaggctgagcctccagatgctgttacctcagatttaatcactggttgaaactccgtataatctgtagagcctccatggctctaaaatttggaattaacttctcttgccttaagagctgcttgtacatatgtggatagctatgtataaaagcttcattttaaag

SEQ ID NO: 279567 - DNA, 726 bp, Homo sapiens
ccgcctcccgaggccccgggtgagaaacgggggagacgcgaggggcggagcttgtggaggaagatggctgccgcctgggggtcgtccctaacggccgcgacgcagagagcggtcactccctggccgaggggcagtccggattccaatacaaattttcactggatacagttatcaaccccgacgacagggtatttgaacagggtggggcaagagtggtggttgactctgatagcttggccttcgtgaaaggggcccaggtggacttcagccaagaactgatccgaagctcatttcaagtgttgaacaatcctcaagcacagcaaggctgctcctgtgggtcatctttctctatcaaactttgatgtgatgactggtgactctgggattgtcaccagttgtaccaatttgaagaacctggaattagtagaattctagaagtttacttctaatcatgtccctctcaattttatttcccgcagtccaggagtgttatgttttgccactattattttcagaatgtgaagattttactcttggcttaatttttccctccactcagtgctaaggctgagcctccagatgctgttacctcagatttaatcactggttgaaactccgtataatctgtagagcctccatggctctaaaatttggaattaacttctcttgccttaagagctgcttgtacatatgtggatagctatgtataaaagcttcattttaaag

SEQ ID NO: 279568 - DNA, 1122 bp, Homo sapiens
  misc_feature (897)..(897): n is a, c, g, or t
  misc_feature (901)..(902): n is a, c, g, or t
  misc_feature (908)..(908): n is a, c, g, or t
ccgcctcccgaggccccgggtgagaaacgggggagacgcgaggggcggagcttgtggaggaagatggctgccgcctgggggtcgtccctaacggccgcgacgcagagagcggtcactccctggccgaggggcaggctcctcacggcctccctgggaccccaggcgcgtcgggaggcgtcgtcctccagccccgaggccggcgaagggcagatccgcctcacagacagttgcgtccagaggcttttggaaatcaccgaagggtcagaattcctcaggctgcaagtggagggaggtggatgctccggattccaatacaaattttcactggatacagttatcaaccccgacgacagggtatttgaacagggtggggcaagagtggtggttgactctgatagcttggccttcgtgaaaggggcccaggtggacttcagccaagaactgatccgaagctcatttcaagtgttgaacaatcctcaagcacagcaaggctgctcctgtgggtcatctttctctatcaaactttgatgtgatgactggtgactctgggattgtcaccagttgtaccaatttgaagaacctggaattagtagaattctagaagtttacttctaatcatgtccctctcaattttatttcccgcagtccaggagtgttatgttttgccactattattttcagaatgtgaagattttactcttggcttaatttttccctccactcagtgctaaggctgagcctccagatgctgttacctcagatttaatcactggttgaaactccgtataatctgtagagcctccatggctctaaaatttggaattaacttctcttgccttaagagctgcttgtacatatgtggatagctatgtataaaagcttcattttaaaggtaanaaannaaaaanaaaaaaaaaaaaaaaccttgtcggccgcctgggcccagtcacttctagactcaagcaagttaatgcatgcggccgaaattcggctaactggcccaatccgcccttagtgagtcgaatacattccactgcccgcggtttaacaacgcggaactggaaaaccctgccgtcaccaactaatcgccttgagaaatccccttttgcagctgggaatacc

SEQ ID NO: 279569 - DNA, 1752 bp, Homo sapiens
ccgcctcccgaggccccgggtgagaaacgggggagacgcgaggggcggagcttgtggaggaagatggctgccgcctgggggtcgtccctaacggccgcgacgcagagagcggtcactccctggccgaggggcaggctcctcacggcctccctgggaccccaggcgcgtcgggaggcgtcgtcctccagccccgaggccggcgaagggcagatccgcctcacagacagttgcgtccagaggcttttggaaatcaccgaagggtcagaattcctcaggctgcaagtggagggaggtggatgctccggattccaatacaaattttcactggatacagttatcaaccccgacgacagggtatttgaacagggtggggcaagagtggtggttgactctgatagcttggccttcgtgaaaggggcccaggtggacttcagccaagaactgatccgaagctcatttcaagtgttgaacaatcctcaagcacagcaaggctgctcctgtgggtcatctttctctatcaaactttgatgtgatgactggtgactctgggattgtcaccagttgtaccaatttgaagaacctggaattagtagaattctagaagtttacttctaatcatgtccctctcaattttatttcccgcagtccaggagtgttatgttttgccactattattttcagaatgtgaagattttactcttggcttaatttttccctccactcagtgctaaggctgagcctccagatgctgttacctcagatttaatcactggttgaaactccgtataatctgtagagcctccatggctctaaaatttggaattaacttctcttgccttaagagctgcttgtacatatgtggatagctatgtataaaagcttcattttaaagaaggttcttattgtgttgtggatcagggtcacagattgggtagcttggacaccagttattagaggatgagaaaagtaaatgaaatgttctctttttcacttcaccctgccagaatgtgccacttgacttatctttattgtctatgcaacccatttgccacttcctgtttgataggacagatacattttactctcatgctcgtggatctgctatgagtcataaaaccaagagcccgttacccagaaaacttggaccaaaccctcactgatagtgaattatttcaaaaatagcctccctactcatacagacattttaagattctgtgacaatttaatgactgaatctttttaggatatgttgctttacctgccttctgttgtaaaatggctctggtctcatgcacagcaggaagtgatccctttattgttataggtaatagattcttgggaacctttttttagattgggttaccagatgaaatgtaggatgcccagttaaatttgaatttcaggtaaataattttttagtatgcatatgtctcaaatattgcatatactaaaaattactatttgaaattcaaatttaactcatatttttatttgctgaccttggcaactctgctttagggtcaccaaacagcttttaaaatcacaaattctagtgaattaaagtacttgtgtaggtgtggcacttaaataggcttcggagcttgaaataatcctgttagagtactgtggagctgtgtggacagacagtgaaagaaatctaccaccatcaccacaccgaatgatttattaatactgatgttggagaaactacaaccaagttgattctggaagagttactggttaaatccatct

SEQ ID NO: 279570 - DNA, 895 bp, Homo sapiens
ccgcctcccgaggccccgggtgagaaacgggggagacgcgaggggcggagcttgtggaggaagatggctgccgcctgggggtcgtccctaacggccgcgacgcagagagcggtcactccctggccgaggggcaggctcctcacggcctccctgggaccccaggcgcgtcgggaggcgtcgtcctccagccccgaggccggcgaagggcagatccgcctcacagacagttgcgtccagaggcttttggaaatcaccgaagggtcagaattcctcaggctgcaagtggagggaggtggatgctccggattccaatacaaattttcactggatacagttatcaaccccgacgacagggtatttgaacagggtggggcaagagtggtggttgactctgatagcttggccttcgtgaaaggggcccaggtggacttcagccaagaactgatccgaagctcatttcaagtgttgaacaatcctcaagcacagcaaggctgctcctgtgggtcatctttctctatcaaactttgatgtgatgactggtgactctgggattgtcaccagttgtaccaatttgaagaacctggaattagtagaattctagaagtttacttctaatcatgtccctctcaattttatttcccgcagtccaggagtgttatgttttgccactattattttcagaatgtgaagattttactcttggcttaatttttccctccactcagtgctaaggctgagcctccagatgctgttacctcagatttaatcactggttgaaactccgtataatctgtagagcctccatggctctaaaatttggaattaacttctcttgccttaaaatgaagcttttatacatagctatccacataagtacaagcagctcttaaggcag

SEQ ID NO: 279571 - DNA, 1772 bp, Homo sapiens
tacaggcgaggagccaaggaccagactgtggaacactgtgggtactagcggacgggccgtgacccggatgaagcagaggggcgcctgagttcccgtcacctaagcgacagcctgcgagcctctcttcccctcccccacccaagccccagcccggcctccgctccggccgccgccaccgcccctgttttgtttccatggcgacaggcggcgcagggcccgctccaaacataacgcgctgtggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgactctccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagagaagtacaatgctgattatgatctgtcagctcggcaaggggcagacaccctggccttcatgtctctcctggaggagaagttgctcccggtgctggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactga

SEQ ID NO: 279572 - DNA, 1679 bp, Homo sapiens
tacaggcgaggagccaaggaccagactgtggaacactgtgggtactagcggacgggccgtgacccggatgaagcagaggggcgcctgagttcccgtcacctaagcgacagcctgcgagcctctcttcccctcccccacccaagccccagcccggcctccgctccggccgccgccaccgcccctgttttgtttccatggcgacaggcggcgcagggcccgctccaaacataacgcgctgtggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgactctccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagaggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactga

SEQ ID NO: 279573 - DNA, 1973 bp, Homo sapiens
tacaggcgaggagccaaggaccagactgtggaacactgtgggtactagcggacgggccgtgacccggatgaagcagaggggcgcctgagttcccgtcacctaagcgacagcctgcgagcctctcttcccctcccccacccaagccccagcccggcctccgctccggccgccgccaccgcccctgttttgtttccatggcgacaggcggcgcagggcccgctccaaacataacgcgctgtggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgactctccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagagaagtacaatgctgattatgatctgtcagctcggcaaggggcagacaccctggccttcatgtctctcctggaggagaagttgctcccggtgctggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactgaaaaaaaaaaaaaccagcgcacacccacacccctacttaaccaatgcgcacaccaaacacacggtccccgcgcgcggggacgggcgacacgccacaccacacaagacgtgcgcgactcaacgcgcggcacctcccccgcgcaccatcttacgcggccacacccaagaaagtcgctcccccacaaacggcgagcgggggcgca

SEQ ID NO: 279574 - DNA, 2686 bp, Homo sapiens
tacaggcgaggagccaaggaccagactgtggaacactgtgggtactagcggacgggccgtgacccggatgaagcagaggggcgcctgagttcccgtcacctaagcgacagcctgcgagcctctcttcccctcccccacccaagccccagcccggcctccgctccggccgccgccaccgcccctgttttgtttccatggcgacaggcggcgcagggcccgctccaaacataacgcgctgtggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgactctccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagaggtaggtgacttggatagagggggctgccagtgagagaagttcagtcaattctatacaatacacatttattgagcaccagatatatgccatgctagatgcaggtgacccagagcatcaaggagcaacagtcttgtggcagagacacacacaatgtcactgtgatgtattaaagcagtcggcaagagatgaaacttagggcactgtgaggcagggagggagaggagcacaggctgaaggagagtggaagacagcagttggcctctgatggtgggactggagagagatttctaagggccacttcctgttttcagggactaggttgggctagatatggggctcaggatggacaaggcttagagccaggttggagaagatgaaagagcattactagaggagtggggaggcctaggctatgctctttactctgccattgactatgtgatctcgggcaggccatgtaacctctcagggctgtgcactcccttatttgtaaaactagagggctgggccagcatgttttccaagggttcttctagcattgacggtcaggttccaagagggaacagtgtcagaagtaggacactcttcctcatttctaacttcccaaaggttgaggacctggggaattaattgagaggcctggaaagagaggatccagataaaagccaaagttcctggcagagccgaggccactgccctgattgcttaggtgtgaacagagcttttccagtttccaaagtattctaaattatttcctaacacaggggcattcagagaaagagattcttacccccattccacaggggagaaactgaggcttagggagatttaaggatcatgctgaagaggttatctggggacaaagcttactcaggatgtggagggggatgctgaggaacagggactggagcctgaagtacaatgctgattatgatctgtcagctcggcaaggggcagacaccctggccttcatgtctctcctggaggagaagttgctcccggtgctggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactga

SEQ ID NO: 279575 - DNA, 2189 bp, Homo sapiens
tacaggcgaggagccaaggaccagactgtggaacactgtgggtactagcggacgggccgtgacccggatgaagcagaggggcgcctgagttcccgtcacctaagcgacagcctgcgagcctctcttcccctcccccacccaagccccagcccggcctccgctccggccgccgccaccgcccctgttttgtttccatggcgacaggcggcgcagggcccgctccaaacataacgcgctgtggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgactctccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagaggtaggtgacttggatagagggggctgccagtgagagaagttcagtcaattctatacaatacacatttattgagcaccagatatatgccatgctagatgcaggtgacccagagcatcaaggagcaacagtcttgtggcagagacacacacaatgtcactgtgatgtattaaagcagtcggcaagagatgaaacttagggcactgtgaggcagggagggagaggagcacaggctgaaggagagtggaagacagcagttggcctctgatggggcattcagagaaagagattcttacccccattccacaggggagaaactgaggcttagggagatttaaggatcatgctgaagaggttatctggggacaaagcttactcaggatgtggagggggatgctgaggaacagggactggagcctgaagtacaatgctgattatgatctgtcagctcggcaaggggcagacaccctggccttcatgtctctcctggaggagaagttgctcccggtgctggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactga

SEQ ID NO: 279576 - DNA, 1987 bp, Homo sapiens
tacaggcgaggagccaaggaccagactgtggaacactgtgggtactagcggacgggccgtgacccggatgaagcagaggggcgcctgagttcccgtcacctaagcgacagcctgcgagcctctcttcccctcccccacccaagccccagcccggcctccgctccggccgccgccaccgcccctgttttgtttccatggcgacaggcggcgcagggcccgctccaaacataacgcgctgtggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgactctccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagaggtaggtgacttggatagagggggctgccagtgagagaagttcagtcaattctatacaatacacatttattgagcaccagatatatgccatgctagatgcaggtgacccagagcatcaaggagcaacagtcttgtggcagagacacacacaatgtcactgtgatgtattaaagcagtcggcaagagatgaaacttagggcactgtgaggcagggagggagaggagcacaggctgaaggagagtggaagacagcagttggcctctgatggtgggactggagagagatttctaagggccacttcctgttttcagggactaggttgggctagatatggggctcaggatggacaaggcttagagccaggttggagaagatgaaagagcattactagaggagtggggaggcctaggctatgctctttactctgccattgactatgtgatctcgggcaggccatgtaacctctcagggctgtgcactcccttatttgtaaaactagagggctgggccagcatgttttccaagggttcttctagcattgacggtcaggttccaagagggaacagtgtcagaagtaggacactcttcctcatttctaacttcccaaaggttgaggacctggggaattaattgagaggcctggaaagagaggatccagataaaagccaaagttcctggcagagccgaggccactgccctgattgcttaggtgtgaacagagcttttccagtttccaaagtattctaaattatttcctaacacaggggcattcagagaaagagattcttacccccattccacaggggagaaactgaggcttagggagatttaaggatcatgctgaagaggttatctggggacaaagcttactcaggatgtggagggggatgctgaggaacagggactggagcctgggaaggtagggcaggctgagaacctgggggtatgggtggaatgtgtatgtggtaatgaggagcgtccgaagtgcacataaagtacagctaatgatcccgaaggagggaccataagggaaaaagccgtgagggagcagctgtgaaaaacg

SEQ ID NO: 279577 - DNA, 1369 bp, Homo sapiens
aaagggtttgctgcaactgattttaagatgcatctccattttagagatgttaaaatgttttaaaaaatgtgtttcagatttagtgaaatatggcatgtgtttcagatttagtgaaatatggtatgcgtttcatagaacaatatctgatgtaactaaatacactgagcattagtgaaagtgtaagggcctcgaaaagagaagtacaatgctgattatgatctgtcagctcagcaaggggcagacaccctggccttcatgtctctcctggaggagaagttgatcccggtgctggtgagtgtgcccagacctcccagcatccatggccagccggggaggggacgggaacacacagacccacacagagactcaggagagcatggaggtcagaagcccaccttgaatcagacaggtgcactggctcagacctgcctgtttcttcctgcccacccaatccaggtacatactttttggatagacaccaagaactacgtagaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggaggtagctctgagaccgggggctattgtatgagatgagccccaaggatgctggccaggaatgggagtgcttaggtgcagaggtggcactgttcccgcagctgcaagcctacctgtgtcgcccctacagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactgactgggctcaaacattttctcctttaagagctg

SEQ ID NO: 279578 - DNA, 1567 bp, Homo sapiens
tacaggcgaggagccaaggaccagactgtggaacactgtgggtactagcggacgggccgtgacccggatgaagcagaggggcgcctgagttcccgtcacctaagcgacagcctgcgagcctctcttcccctcccccacccaagccccagcccggcctccgctccggccgccgccaccgcccctgttttgtttccatggcgacaggcggcgcagggcccgctccaaacataacgcgctgtggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgactctccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagaggtaggtgacttggatagagggggctgccagtgagagaagttcagtcaattctatacaatacacatttattgagcaccagatatatgccatgctagatgcaggtgacccagagcatcaaggagcaacagtcttgtggcagagacacacacaatgtcactgtgatgtattaaagcagtcggcaagagatgaaacttagggcactgtgaggcagggagggagaggagcacaggctgaaggagagtggaagacagcagttggcctctgatggtgggactggagagagatttctaagggccacttcctgttttcagggactaggttgggctagatatggggctcaggatggacaaggcttagagccagaagtacaatgctgattatgatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactga

SEQ ID NO: 279579 - DNA, 247 bp, Homo sapiens
ctctgagccctgtgttgtccatttgtaaaatagaaatggtagtgactcccccttttttttcgagactaagatactaagtatagggaatggcacataaggtattcaataaatgttatttctcttcttgataccactgtgggggacatggctctgcctctctgacttctgcttccttccctgcagacctatgccagatttactggtgctccactgaaggtacacaagatcagcaacccctggcagagcc

SEQ ID NO: 279580 - DNA, 708 bp, Homo sapiens
gcagccaggcacaggaagggcctgaagagctgtggggcactgagtgtgccctttatgcagccctgggatagagccctattcagggccagctggcgccacctggggatctctccccataccaggtctagaactgtgtgtcctgtccttccctggtggccgcctgctgcccagagcccacctcccaaggctgactcttcctccagctccatctttaccccttctaccccagtggttctcctccatcccacccttctctctctgctccagccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggaggtaaggggcagatgggaggggcagccctggggagagtgggcagggatccaagaactagttctcctaacacaccttccttccttgaccctcagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggct

SEQ ID NO: 279581 - DNA, 374 bp, Homo sapiens
agctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactgactgggctcaaacattttctcctttaagagctg

SEQ ID NO: 279582 - DNA, 1792 bp, Homo sapiens
tacaggcgaggagccaaggaccagactgtggaacactgtgggtactagcggacgggccgtgacccggatgaagcagaggggcgcctgagttcccgtcacctaagcgacagcctgcgagcctctcttcccctcccccacccaagccccagcccggcctccgctccggccgccgccaccgcccctgttttgtttccatggcgacaggcggcgcagggcccgctccaaacataacgcgctgtggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgactctccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagagaagtacaatgctgattatgatctgtcagctcggcaaggggcagacaccctggccttcatgtctctcctggaggagaagttgctcccggtgctggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactgactgggctcaaacattttctc

SEQ ID NO: 279583 - DNA, 1792 bp, Homo sapiens
tacaggcgaggagccaaggaccagactgtggaacactgtgggtactagcggacgggccgtgacccggatgaagcagaggggcgcctgagttcccgtcacctaagcgacagcctgcgagcctctcttcccctcccccacccaagccccagcccggcctccgctccggccgccgccaccgcccctgttttgtttccatggcgacaggcggcgcagggcccgctccaaacataacgcgctgtggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgactctccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggtacccagtatcccttgggggaactctgcctgcccttcggaccagtcatggagaggtcatctcagttccacacaagatcatcacccaccttcgaaaagagaagtacaatgctgattatgatctgtcagctcggcaaggggcagacaccctggccttcatgtctctcctggaggagaagttgctcccggtgctggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactga

SEQ ID NO: 279584 - DNA, 2024 bp, Homo sapiens
tacaggcgaggagccaaggaccagactgtggaacactgtgggtactagcggacgggccgtgacccggatgaagcagaggggcgcctgagttcccgtcacctaagcgacagcctgcgagcctctcttcccctcccccacccaagccccagcccggcctccgctccggccgccgccaccgcccctgttttgtttccatggcgacaggcggcgcagggcccgctccaaacataacgcgctgtggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgactctccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagaggtaggtgacttggatagagggggctgccagtgagagaagttcagtcaattctatacaatacacatttattgagcaccagatatatgccatgctagatgcaggtgacccagagcatcaaggagcaacagtcttgtggcagagacacacacaatgtcactgtgatgtattaaagcagtcggcaagagatgaaacttagggcactgtgaggcagggagggagaggagcacaggctgaaggagagtggaagacagcagttggcctctgatggtgggactggagagagatttctaagggccacttcctgttttcagggactaggttgggctagatatggggctcaggatggacaaggcttagagccaggttggagaagatgaaagagcattactagaggagtggggaggcctaggctatgctctttactctgccattgactatgtgatctcgggcaggccatgtaacctctcagggctgtgcactcccttatttgtaaaactagagggctgggccagcatgttttccaagggttcttctagcattgacggtcaggttccaagagggaacagtgtcagaagtaggacactcttcctcatttctaacttcccaaaggttgaggacctggggaattaattgagaggcctggaaagagaggatccagataaaagccaaagttcctggcagagccgaggccactgccctgattgcttaggtgtgaacagagcttttccagtttccaaagtattctaaattatttcctaacacaggggcattcagagaaagagattcttacccccattccacaggggagaaactgaggcttagggagatttaaggatcatgctgaagaggttatctggggacaaagcttactcaggatgtggagggggatgctgaggaacagggactggagcctggcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactga

SEQ ID NO: 279585 - DNA, 1052 bp, Homo sapiens
aaagggtttgctgcaactgattttaagatgcatctccattttagagatgttaaaatgttttaaaaaatgtgtttcagatttagtgaaatatggcatgtgtttcagatttagtgaaatatggtatgcgtttcatagaacaatatctgatgtaactaaatacactgagcattagtgaaagtgtaagggcctcgaaaagagaagtacaatgctgattatgatctgtcagctcagcaaggggcagacaccctggccttcatgtctctcctggaggagaagttgatcccggtgctggtgagtgtgcccagacctcccagcatccatggccagccggggaggggacgggaacacacagacccacacagagactcaggagagcatggaggtcagaagcccaccttgaatcagacaggtgcactggctcagacctgcctgtttcttcctgcccacccaatccaggtacatactttttggatagacaccaagaactacgtagaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggaggtagctctgagaccgggggctattgtatgagatgagccccaaggatgctggccaggaatgggagtgcttaggtgcagaggtggcactgttcccgcagctgcaagcctacctgtgtcgcccctacagctgtaccgagaggctcgggagtgtctgaccctgctctctcagcgcctgggctctcaaaagttcttctttggagatgcgtgagtctgactccaagagggtaatgggtggcttggaagaagatacaggttcagatggagcagctggagctggggctggggctggggctgactcaggctctggataggaggtccctgagacagatactggcctggtgacagtgggctgtgcgtgggccagagccttctcagaggtacaaaagggtaggtgtccaccctttcgtctaaggc

SEQ ID NO: 279586 - DNA, 5188 bp, Homo sapiens
gggaagcgggaggagagccacacggtcaagttgcacaggttcttgcagcttctggaatcaagaccatgggcaccctcataagtcagtgtgggcagggactgccccagggccaatccaagatccagaggtagccatagggtgtgacaagttgtgcagattacaacactcaccccttgcaataacgtcactgcctgtgactcggggccaggcccaggccaaagcccttcctacatcatttcgtttaatcctcacagtttcctgctgaaagggctactattcttactcccatccccactctacagatgaggtaatggaggcccaggaaagttaagtgacttgtcccagatgacaccgctggtaagttgcaaagtcagaatttgaactcaggcagtttacctctgatggctgctctgttaatcacagctgctttccagtgagacaaaaacgggtgatcagggcagagtcaagacagagaggtaaacaagattgggaaaaagacaggaatgagaggggaacaatgggggaaaagataggaacaaagagagttggggaaggggagagaaacaggaaacatgacttgcccgggaggggcatcagtccacgtgcaagcaggtggaggctcaagttttctgctcacttggtgatgcagaggctccctttccctcagcagccgccttgctgcgtggacagcagcttcccatctggcctgtccccggagccccggcctcatcctcctcagcggcaggccacttagcttcacaggaaatgctctttctctaattggcattgaaactcacagccctcccttttcctgtaggtggggtttccataggaaaaagctgcttctctgtttccccagcctagcaactgtttggcagtcagagtcccacatcctgctcaactgggtcaggtccctcttagaccagctcttgtccatcatttgctgaagtggaccaactagttccccagtagggggtctcccctggcaattcttgatcggcgtttggacatctcagatcgcttccaatgaagatggccttgccttggggtcctgcttgtttcataatcatctaactatgggacaaggttgtgccggcagctctgggggaaggagcacggggctgatcaagccatccaggaaacactggaggacttgtccagccttgaaagaactctagtggtttctgaatctagcccacttggcggtaagcatgatgcaacttctgcaacttctgctggggcttttggggccaggtggctacttatttcttttaggggattgtcaggaggtgaccactctcacggtgaaataccaagtgtcagaggaagtgccatctggtacagtgatcgggaagctgtcccaggaactgggccgggaggagaggcggaggcaagctggggccgccttccaggtgttgcagctgcctcaggcgctccccattcaggtggactctgaggaaggcttgctcagcacaggcaggcggctggatcgagagcagctgtgccgacagtgggatccctgcctggtttcctttgatgtgcttgccacaggggatttggctctgatccatgtggagatccaagtgctggacatcaatgaccaccagccacggtttcccaaaggcgagcaggagctggaaatctctgagagcgcctctctgcgaacccggatccccctggacagagctcttgacccagacacaggccctaacaccctgcacacctacactctgtctcccagtgagcactttgccttggatgtcattgtgggccctgatgagaccaaacatgcagaactcatagtggtgaaggagctggacagggaaatccattcattttttgatctggtgttaactgcctatgacaatgggaacccccccaagtcaggtaccagcttggtcaaggtcaacgtcttggactccaatgacaatagccctgcgtttgctgagagttcactggcactggaaatccaagaagatgctgcacctggtacgcttctcataaaactgaccgccacagaccctgaccaaggccccaatggggaggtggagttcttcctcagtaagcacatgcctccagaggtgctggacaccttcagtattgatgccaagacaggccaggtcattctgcgtcgacctctagactatgaaaagaaccctgcctacgaggtggatgttcaggcaagggacctgggtcccaatcctatcccagcccattgcaaagttctcatcaaggttctggatgtcaatgacaacatcccaagcatccacgtcacatgggcctcccagccatcactggtgtcagaagctcttcccaaggacagttttattgctcttgtcatggcagatgacttggattcaggacacaatggtttggtccactgctggctgagccaagagctgggccacttcaggctgaaaagaactaatggcaacacatacatgttgctaaccaatgccacactggacagagagcagtggcccaaatataccctcactctgttagcccaagaccaaggactccagcccttatcagccaagaaacagctcagcattcagatcagtgacatcaacgacaatgcacctgtgtttgagaaaagcaggtatgaagtctccacgcgggaaaacaacttaccctctcttcacctcattaccatcaaggctcatgatgcagacttgggcattaatggaaaagtctcataccgcatccaggactccccagttgctcacttagtagctattgactccaacacaggagaggtcactgctcagaggtcactgaactatgaagagatggccggctttgagttccaggtgatcgcagaggacagcgggcaacccatgcttgcatccagtgtctctgtgtgggtcagcctcttggatgccaatgataatgccccagaggtggtccagcctgtgctcagcgatggaaaagccagcctctccgtgcttgtgaatgcctccacaggccacctgctggtgcccatcgagactcccaatggcttgggcccagcgggcactgacacacctccactggccactcacagctcccggccattccttttgacaaccattgtggcaagagatgcagactcgggggcaaatggagagcccctctacagcatccgcagtggaaatgaagcccacctcttcatcctcaaccctcatacggggcagctgttcgtcaatgtcaccaatgccagcagcctcattgggagtgagtgggagctggagatagtagtagaggaccagggaagcccccccttacagacccgagccctgttgagggtcatgtttgtcaccagtgtggaccacctgagggactcagcccgcaagcctggggccttgagcatgtcgatgctgacggtgatctgcctggctgtactgttgggcatcttcgggttgatcctggctttgttcatgtccatctgccggacagaaaagaaggacaacagggcctacaactgtcgggaggccgagtccacctaccgccagcagcccaagaggccccagaaacacattcagaaggcagacatccacctcgtgcctgtgctcaggggtcaggcaggtgagccttgtgaagtcgggcagtcccacaaagatgtggacaaggaggcgatgatggaagcaggctgggacccctgcctgcaggcccccttccacctcaccccgaccctgtacaggacgctgcgtaatcaaggcaaccagggagcaccggcggagagccgagaggtgctgcaagacacggtcaacctccttttcaaccatcccaggcagaggaatgcctcccgggagaacctgaaccttcccgagccccagcctgccacaggccagccacgttccaggcctctgaaggttgcaggcagccccacagggaggctggctggagaccagggcagtgaggaagccccacagaggccaccagcctcctctgcaaccctgagacggcagcgacatctcaatggcaaagtgtcccctgagaaagaatcagggccccgtcagatcctgcggagcctggtccggctgtctgtggctgccttcgccgagcggaaccccgtggaggagctcactgtggattctcctcctgttcagcaaatctcccagctgctgtccttgctgcatcagggccaattccagcccaaaccaaaccaccgaggaaataagtacttggccaagccaggaggcagcaggagtgcaatcccagacacagatggcccaagtgcaagggctggaggccagacagacccagaacaggaggaagggcctttggatcctgaagaggacctctctgtgaagcaactgctagaagaagagctgtcaagtctgctggaccccagcacaggtctggccctggaccggctgagcgcccctgacccggcctggatggcgagactctctttgcccctcaccaccaactaccgtgacaatgtgatctccccggatgctgcagccacggaggagccaaggaccttccagacgttcggcaaggcagaggcaccagagctgagcccaacaggcacgaggctggccagcacctttgtctcggagatgagctcactgctggagatgctgctggaacagcgctccagcatgcccgtggaggccgcctccgaggcgctgcggcggctctcggtctgcgggaggaccctcagtttagacttggccaccagtgcagcctcaggcatgaaagtgcaaggggacccaggtggaaagacggggactgagggcaagagcagaggcagcagcagcagcagcaggtgcctgtgaacatacctcagacgcctctggatccaagaaccaggggcctgaggatctgtggacaagagctggtttctaaaatcttgtaactcactagctagcggcggcctgagaactttagggtgactgatgctacccccacagaggaggcaagagccccaggactaacagctgactgaccaaagcagccccttgtaagcagctctgagtcttttggaggacagggacggtttgtggctgagataagtgtttcctggcaaaacatatgtggagcacaaagggtcagtcctctggcagaacagatgccacggagtatcacaggcaggaaagggtggccttcttgggtagcaggagtcagggggctgtaccctgggggtgccaggaaatgctctctgacctatcaataaaggaaaagcagtgattcattctcc

SEQ ID NO: 279587 - DNA, 474 bp, Homo sapiens
tgtgaggtgggtgttatttattactctcattttacaaatgaggaaacagagtaagaggagggcgggaatcacatgatccaggttggtctgactctagaggccaggctgtgtatccagttccctatatgggtaaatgaatgcaaacatgaatgggcatgaatgaatgaatctatatgggaatgtccctacccatggactggttggtttcttttgcaggagtgcaatcccagacacagatggcccaagtgcaagggctggaggccagacagacccagaacaggaggaagggcctttggatcctgaagaggacctctctgtgaagcaactgctagaagaagagctgtcaagtctgctggaccccagcacaggtagggaccccctggagttaccttgaccctgcttctgccccatggtgtccaagcttcagagttctgctccaatccactgcagggaaaagccattctgtttctgtgg

SEQ ID NO: 279588 - DNA, 2345 bp, Homo sapiens
  misc_feature (17)..(17): n is a, c, g, or t
tcgagctccggtacccngacgctctctcatgtgggggacgctctctcatgtggggagaaggtggtccagcctgtgctcagcgatggaaaagccagcctctccgtgcttgtgaatgcctccacaggccacctgctggtgcccatcgagactcccaatggcttgggcccagcgggcactgacacacctccactggccactcacagctcccggccattccttttgacaaccattgtggcaagagatgcagactcgggggcaaatggagagcccctctacagcatccgcagtggaaatgaagcccacctcttcatcctcaaccctcatacggggcagctgttcgtcaatgtcaccaatgccagcagcctcattgggagtgagtgggagctggagatagtagtagaggaccagggaagcccccccttacagacccgagccctgttgagggtcatgtttgtcaccagtgtggaccacctgagggactcagcccgcaagcctggggccttgagcatgtcgatgctgacggtgatctgcctggctgtactgttgggcatcttcgggttgatcctggctttgttcatgtccatctgccggacagaaaagaaggacaacagggcctacaactgtcgggaggccgagtccacctaccgccagcagcccaagaggccccagaaacacattcagaaggcagacatccacctcgtgcctgtgctcaggggtcaggcaggtgagccttgtgaagtcgggcagtcccacaaagatgtggacaaggaggcgatgatggaagcaggctgggacccctgcctgcaggcccccttccacctcaccccgaccctgtacaggacgctgcgtaatcaaggcaaccagggagcaccggcggagagccgagaggtgctgcaagacacggtcaacctccttttcaaccatcccaggcagaggaatgcctcccgggagaacctgaaccttcccgagccccagcctgccacaggccagccacgttccaggcctctgaaggttgcaggcagccccacagggaggctggctggagaccagggcagtgaggaagccccacagaggccaccagcctcctctgcaaccctgagacggcagcgacatctcaatggcaaagtgtcccctgagaaagaatcagggccccgtcagatcctgcggagcctggtccggctgtctgtggctgccttcgccgagcggaaccccgtggaggagctcactgtggattctcctcctgttcagcaaatctcccagctgctgtccttgctgcatcagggccaattccagcccaaaccaaaccaccgaggaaataagtacttggccaagccaggaggcagcaggagtgcaatcccagacacagatggcccaagtgcaagggctggaggccagacagacccagaacaggaggaagggcctttggatcctgaagaggacctctctgtgaagcaactgctagaagaagagctgtcaagtctgctggaccccagcacaggtctggccctggaccggctgagcgcccctgacccggcctggatggcgagactctctttgcccctcaccaccaactaccgtgacaatgtgatctccccggatgctgcagccacggaggagccaaggaccttccagacgttcggcaaggcagaggcaccagagctgagcccaacaggcacgaggctggccagcacctttgtctcggagatgagctcactgctggagatgctgctggaacagcgctccagcatgcccgtggaggccgcctccgaggcgctgcggcggctctcggtctgcgggaggaccctcagtttagacttggccaccagtgcagcctcaggcatgaaagtgcaaggggacccaggtggaaagacggggactgagggcaagagcagaggcagcagcagcagcagcaggtgcctgtgaacatacctcagacgcctctggatccaagaaccaggggcctgaggatctgtggacaagagctggtttctaaaatcttgtaactcactagctagcggcggcctgagaactttagggtgactgatgctacccccacagaggaggcaagagccccaggactaacagctgactgaccaaagcagccccttgtaagcagctctgagtcttttggaggacagggacggtttgtggctgagataagtgtttcctggcaaaacatatgtggagcacaaagggtcagtcctctggcagaacagatgccacggagtatcacaggcaggaaagggtggccttcttgggtagcaggagtcagggggctgtaccctgggggtgccaggaaatgctctctgacctatcaataaaggaaaagcagtgattcattctcc

SEQ ID NO: 279589 - DNA, 188 bp, Homo sapiens
aagtgtgctgagtcggaattgtgtggagtcaacagatttttcctgtcttgtagcaaatctcccagctgctgtccttgctgcatcagggccaattccagcccaaaccaaaccaccgaggaaataagtacttggccaagccaggaggcagcaggtaagcagcacgtagcccccacaggcatctcaaggcc

SEQ ID NO: 279590 - DNA, 2467 bp, Homo sapiens
gggaagcgggaggagagccacacggtcaagttgcacaggttcttgcagcttctggaatcaagaccatgggcaccctcataagtcagtgtgggcagggactgccccagggccaatccaagatccagaggtagccatagggtgtgacaagttgtgcagattacaacactcaccccttgcaataacgtcactgcctgtgactcggggccaggcccaggccaaagcccttcctacatcatttcgtttaatcctcacagtttcctgctgaaagggctactattcttactcccatccccactctacagatgaggtaatggaggcccaggaaagttaagtgacttgtcccagatgacaccgctggtaagttgcaaagtcagaatttgaactcaggcagtttacctctgatggctgctctgttaatcacagctgctttccagtgagacaaaaacgggtgatcagggcagagtcaagacagagaggtaaacaagattgggaaaaagacaggaatgagaggggaacaatgggggaaaagataggaacaaagagagttggggaaggggagagaaacaggaaacatgacttgcccgggaggggcatcagtccacgtgcaagcaggtggaggctcaagttttctgctcacttggtgatgcagaggctccctttccctcagcagccgccttgctgcgtggacagcagcttcccatctggcctgtccccggagccccggcctcatcctcctcagcggcaggccacttagcttcacaggaaatgctctttctctaattggcattgaaactcacagccctcccttttcctgtaggtggggtttccataggaaaaagctgcttctctgtttccccagcctagcaactgtttggcagtcagagtcccacatcctgctcaactgggtcaggtccctcttagaccagctcttgtccatcatttgctgaagtggaccaactagttccccagtagggggtctcccctggcaattcttgatcggcgtttggacatctcagatcgcttccaatgaagatggccttgccttggggtcctgcttgtttcataatcatctaactatgggacaaggttgtgccggcagctctgggggaaggagcacggggctgatcaagccatccaggaaacactggaggacttgtccagccttgaaagaactctagtggtttctgaatctagcccacttggcggtaagcatgatgcaacttctgcaacttctgctggggcttttggggccaggtggctacttatttcttttaggggattgtcaggaggtgaccactctcacggtgaaataccaagtgtcagaggaagtgccatctggtacagtgatcgggaagctgtcccaggaactgggccgggaggagaggcggaggcaagctggggccgccttccaggtgttgcagctgcctcaggcgctccccattcaggtggactctgaggaaggcttgctcagcacaggcaggcggctggatcgagagcagctgtgccgacagtgggatccctgcctggtttcctttgatgtgcttgccacaggggatttggctctgatccatgtggagatccaagtgctggacatcaatgaccaccagccacggtttcccaaaggcgagcaggagctggaaatctctgagagcgcctctctgcgaacccggatccccctggacagagctcttgacccagacacaggccctaacaccctgcacacctacactctgtctcccagtgagcactttgccttggatgtcattgtgggccctgatgagaccaaacatgcagaactcatagtggtgaaggagctggacagggaaatccattcattttttgatctggtgttaactgcctatgacaatgggaacccccccaagtcaggtaccagcttggtcaaggtcaacgtcttggactccaatgacaatagccctgcgtttgctgagagttcactggcactggaaatccaagaagatgctgcacctggtacgcttctcataaaactgaccgccacagaccctgaccaaggccccaatggggaggtggagttcttcctcagtaagcacatgcctccagaggtgctggacaccttcagtattgatgccaagacaggccaggtcattctgcgtcgacctctagactatgaaaagaaccctgcctacgaggtggatgttcaggcaagggacctgggtcccaatcctatcccagcccattgcaaagttctcatcaaggttctggatgtcaatgacaacatcccaagcatccacgtcacatgggcctcccagccatcactggtgtcagaagctcttcccaaggacagttttattgctcttgtcatggcagatgacttggattcaggaaagggtggccttcttgggtagcaggagtcagggggctgtaccctgggggtgccaggaaatgctctctgacctatcaataaaggaaaagcagtgattcattctcc

SEQ ID NO: 279591 - DNA, 1215 bp, Homo sapiens
tgtgaggtgggtgttatttattactctcattttacaaatgaggaaacagagtaagaggagggcgggaatcacatgatccaggttggtctgactctagaggccaggctgtgtatccagttccctatatgggtaaatgaatgcaaacatgaatgggcatgaatgaatgaatctatatgggaatgtccctacccatggactggttggtttcttttgcaggagtgcaatcccagacacagatggcccaagtgcaagggctggaggccagacagacccagaacaggaggaagggcctttggatcctgaagaggacctctctgtgaagcaactgctagaagaagagctgtcaagtctgctggaccccagcacaggtctggccctggaccggctgagcgcccctgacccggcctggatggcgagactctctttgcccctcaccaccaactaccgtgacaatgtgatctccccggatgctgcagccacggaggagccaaggaccttccagacgttcggcaaggcagaggcaccagagctgagcccaacaggcacgaggctggccagcacctttgtctcggagatgagctcactgctggagatgctgctggaacagcgctccagcatgcccgtggaggccgcctccgaggcgctgcggcggctctcggtctgcgggaggaccctcagtttagacttggccaccagtgcagcctcaggcatgaaagtgcaaggggacccaggtggaaagacggggactgagggcaagagcagaggcagcagcagcagcagcaggtgcctgtgaacatacctcagacgcctctggatccaagaaccaggggcctgaggatctgtggacaagagctggtttctaaaatcttgtaactcactagctagcggcggcctgagaactttagggtgactgatgctacccccacagaggaggcaagagccccaggactaacagctgactgaccaaagcagccccttgtaagcagctctgagtcttttggaggacagggacggtttgtggctgagataagtgtttcctggcaaaacatatgtggagcacaaagggtcagtcctctggcagaacagatgccacggagtatcacaggcaggaaagggtggccttcttgggtagcaggagtcagggggctgtaccctgggggtgccaggaaatgctctctgacctatcaataaaggaaaagcagtgattcattctcc

SEQ ID NO: 279592 - DNA, 2137 bp, Homo sapiens
ttcgtagtttcctgataaccattcagtcatctatttcaacaccctgacatgacataaaggcaggcacggaaccacacgttcaccatacagacacacgccactttgctggagcattcactaggcgaggcgctccatcggactcactagctgcactcatgaatcggcaccatctgcaggatcactttctggaaatagacaagaagaactgctgtgtgttccgagatgacttcattgccaaggtgttgccgccggtgttggggctggagtttatctttgggcttctgggcaatggccttgccctgtggattttctgtttccacctcaagtcctggaaatccagccggattttcctgttcaacctggcagtagctgactttctactgatcatctgcctgccgttcgtgatggactactatgtgcggcgttcagactggaagtttggggacatcccttgccggctggtgctcttcatgtttgccatgaaccgccagggcagcatcatcttcctcacggtggtggcggtagacaggtatttccgggtggtccatccccaccacgccctgaacaagatctccaattggacagcagccatcatctcttgccttctgtggggcatcactgttggcctaacagtccacctcctgaagaagaagttgctgatccagaatggccctgcaaatgtgtgcatcagcttcagcatctgccataccttccggtggcacgaagctatgttcctcctggagttcctcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctcaaataaccattccaagaagggacattgtcaccaagaaccagcatctctggagaaacagttgggctgttgcatcgagtaatgtcactggactcggcctaaggtttcctggaacttccagattcagagaatctgatttagggaaactgtggcagatgagtgggagactggttgcaaggtgtgaccacaggaatcctggaggaacagagagtaaagcttctaggcatctgaaacttgcttcatctctgacgctcgcaggactgaagatgggcaaattgtaggcgtttctgctgagcagagttggagccagagatctacttgtgacttgttggccttcttcccacatctgcctcagactggggggggctcagctcctcgggtgatatctagcctgcttgtgagctctagcagggataaggagagctgagattggagggaattgtgttgctcctggaggaagcccaggcatcattaaacaagccagtaggtcacctggcttccgtggaccaattcatctttcagacaagctttagcagaaatggactcagggaagagactcacatgctttggttagtatctgtgtttccggtgggtgtaataggggattagccccagaagggactgagctaaacagtgttattatgggaaaggaaatggcattgctgctttcaaccagcgactaatgcaatccattcctctcttgtttatagtaatctaagggttgagcagttaaaacggcttcaggatagaaagctgtttcccacctgtttgcttttaccattaaaagggaaacgtgcctctgccccacgggtagaggggtgcacgttcctcctggttccttcgcttgtgtttctgtacttaccaaaaatctaccacttcaataaattttgataggagaca

SEQ ID NO: 279593 - DNA, 2028 bp, Homo sapiens
ttcgtagtttcctgataaccattcagtcatctatttcaacaccctgacatgacataaaggcaggcacggaaccacacgttcaccatacagacacacgccactttgctggagcattcactaggcgaggcgctccatcggactcactagctgcactcatgaatcggcaccatctgcaggatcactttctggaaatagacaagaagaactgctgtgtgttccgagatgacttcattgccaaggtgttgccgccggtgttggggctggagtttatctttgggcttctgggcaatggccttgccctgtggattttctgtttccacctcaagtcctggaaatccagccggattttcctgttcaacctggcagtagctgactttctactgatcatctgcctgccgttcgtgatggactactatgtgcggcgttcagactggaagtttggggacatcccttgccggctggtgctcttcatgtttgccatgaaccgccagggcagcatcatcttcctcacggtggtggcggtagacaggtatttccgggtggtccatccccaccacgccctgaacaagatctccaattggacagcagccatcatctcttgccttctgtggggcatcactgttggcctaacagtccacctcctgaagaagaagttgctgatccagaatggccctgcaaatgtgtgcatcagcttcagcatctgccataccttccggtggcacgaagctatgttcctcctggagttcctcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctcaaataaccattccaagaagggacattgtcaccaagaaccagcatctctggagaaacagttgggctgttgcatcgagtaatgtcactggactcggcctaaggtttcctggaacttccagattcagagaatctgatttagggaaactgtggcagatgagtgggagactggttgcaaggtgtgaccacaggaatcctggaggaacagagagtaaagcttctaggcatctgaaacttgcttcatctctgacgctcgcaggactgaagatgggcaaattgtaggcgtttctgctgagcagagttggagccagagatctacttgtgacttgttggccttcttcccacatctgcctcagactggggggggctcagctcctcgggtgatatctagcctgcttgtgagctctagcagggataaggagagctgagattggagggaattgtgttgctcctggaggaagcccaggcatcattaaacaagccagtaggtcacctggcttccgtggaccaattcatctttcagacaagctttagcagaaatggactcagggaagagactcacatgctttgggtgttgccaactcatggtgcatggattcaaatgcaataaacagtcctggggagatgtcccgctcctgtagccccatcatgggtgtctgatttggtgagtattctaggtgcttccaacaacctcatccttctgacctgctggcctctctgaagggggtgtctgctctaactggatcaagaataggggacttgtttggaggaacattcttggtttgtgatttg

SEQ ID NO: 279594 - DNA, 510 bp, Homo sapiens
  misc_feature (2)..(2): n is a, c, g, or t
  misc_feature (28)..(31): n is a, c, g, or t
  misc_feature (47)..(47): n is a, c, g, or t
  misc_feature (62)..(63): n is a, c, g, or t
  misc_feature (301)..(301): n is a, c, g, or t
  misc_feature (369)..(371): n is a, c, g, or t
  misc_feature (479)..(479): n is a, c, g, or t
  misc_feature (492)..(492): n is a, c, g, or t
  misc_feature (496)..(496): n is a, c, g, or t
  misc_feature (503)..(503): n is a, c, g, or t
tnggctagacattctcagttttttcagnnnntttcctgataaggggnttacgttccatcacnntgctgaccattgtctactactgaagactaactaacacagtcattaacagcaatggaattttgaggatggaagacatgttttcagattatgcctctgccatctgctcactgtatatattggatgtcttctgtttgtcccctagatgtactcctcatccttcttcaccttactttggctacagatggctgatgtgaatgaacatcagtagcccccatgtcctctgcttccacctggattnggccaacagaaattcccggcagagatgagagggagagaattgagtgagatcaaggtgtcttttcaaannntggttagctctgtcttatgattgcctcaatctatgtgtccttttatgaaaaatcatgagttctttgaagcatcctgctctatagggctctcctaatgattctgataantacttccttgctngatncctttgnacctggg

SEQ ID NO: 279595 - DNA, 482 bp, Homo sapiens
tttttttttaaatcttgtagagcttgttaaccagaacaccactgtaagagaccttgaatctttttgttcccaggactttctgaattttcagcccatatgacatggaagaagagttagaaggggaatctgactgcttggatcagggactgtctggctggtggaacttgaatgtatacaacactcttcatttgcatgttttgacattttaaaaaatgttttcactttccttatctactttgactctaataacatcctgaaaggtaagtagaattattctcataatatgatgaagaacccaaggctctcaagggaacaccactcttggattatttagccccgctcttctacaagaattgcataccccaacccctggagcccctccccatatccatgtttctgccctataatctgatcctttcaccaaaaatgtttagatcaggtacacacacctgaactaaattgggactatcagtttctctctc

SEQ ID NO: 279596 - DNA, 976 bp, Homo sapiens
ggagaggaccaaattatgtcttagttacctggctgctggtggttgtctctgttttttgtagagcacaggtgtaacggctttcagggtgggggtggggaactctccactgagtagtgtgctgatgtgggagatctctggcttggcctcttccggccctcctcccactcagctcccaccaatgatgtatcaataaaacctcttgctgctggagatctgcttacctggtggccagggtggcaagacaagtgaagcctgactatgcctgcagcatccactgtggaaactactacatctttgccatgccaaacacttctgcttaagcatgcaggtgagaagggaagatacatgtaatctgcatgtctgccaccattccttgttaccctttttcatatcccatgagcacagcactccagcggacctacccaaaatatgtgggagttcagtgaaactcaaacagcatgcttctggtcagcctatacagtctctgtcctggtgaggagcatgatcaccaacaggcaagatcttctggccttgaagtttcgcttgagttaaaagagctcatctcaggactttctgaattttcagcccatatgacatggaagaagagttagaaggggaatctgactgcttggatcagggactgtctggctggtggaacttgaatgtatacaacactcttcatttgcatgttttgacattttaaaaaatgttttcactttccttatctactttgactctaataacatcctgaaaggtaagtagaattattctcataatatgatgaagaacccaaggctctcaagggaacaccactcttggattatttagccccgctcttctacaagaattgcataccccaacccctggagcccctccccatatccatgtttctgccctataatctgatcctttcaccaaaaatgtttagatcaggtacacacacctgaactaaattgggactatcagtttctctctc

SEQ ID NO: 279597 - DNA, 1695 bp, Homo sapiens
tcgggtagcatgggtgttctgctagaggatgtgtctggctgggggcggtgtcccaatcgggagggttgccctgatgggggaggttctacagttgtggagatgccaacctggggggcgctccggttggggggtgtgccctctctggttaccccgctctcgctgccactcataggcccgctgcccaggtatgcacaagtcaaggccttttctgcagaccaagtagccttccctggagagcgcccccagcaccacggaagctacctacatgccccgcggtggtcagcccgccttatcccagccccgagacctggagctggagaacccgcccgccagagtcgtagtagtggatggggagtagccgtcccattttcaacacatgtctcattctaaattgacgttttggtgggctggccgaagaaggagaaagacccgcggctccgacctctgacctctaaccccggacgcactttgatttcgccggcttgcgcggaaggctgactccctgggccgcggcctggcgcgggagccgcctgtggggtgtccccggcgcgggagggtgctctggttcaggcccgctgcccaggtatgcacaagtcaaggccttttctgcagaccaagtagccttccctggagagcgcccccagcaccacggaaactacctacatgccccgcggtggtcagcccgccttatcccagccccgagacccaaaacaagaagcatggactgaatttgaggtttctggatggtcgtgtgaaccgaggggacgggtactggactgacaagaaatgagccttgaaggtcaatctgggtgacacccgagtctcctgatggagtttcactatgttgcccaggctgatctggaactcctgacctcaagcaatccacctgcctcagcctcccaaagtactgggattacaggagggagccaccgtgcccggcctggtcctgtgcattttatagataaggtaactgacaaacctagccacagtcaccccttcgccctaaaggagaactggaatttgaacccagagccttcttcaccaccatctccgttgtttctggaagcaccctccaggcaggccagccagcatcacggggcctcccctggggctggaacgtctgcaggatgcccctttgagaaatgctgttccacagaaccctgcctttcaggccttggagacgtgggcaggggagaagcagcgtccctcagagccaggcctggcagtggtgctagcaggggccaaggcccagggagcagggtctcctgtcggagggacctgggcaagcccctccacgcgccagcgggtttctcagcaggggaggtccacaccacaccgcttgggaacctgggtgcctaaacgcaacaggagccaaggcacaaatttaaccaaacaccaaggttgcgtgaggccccatttcatgagccgggctccaaggacgtgtccttaggcggctctggaaggcccagcgccagcccccgtcctctgttaaagggagccagccccgcggctccgcccaggcatggtagcctgagcgcgcccccagggtagtagggggcacctgaggagcagggtctgccctggcatgagcagagcccaggatggggtcagggtcaggccctgccagaggctggagggtgcccaaggcgaggccggtgaggcccagctctacaaataaagtgttttatttacagg

SEQ ID NO: 279598 - DNA, 1604 bp, Homo sapiens
tcgggtagcatgggtgttctgctagaggatgtgtctggctgggggcggtgtcccaatcgggagggttgccctgatgggggaggttctacagttgtggagatgccaacctggggggcgctccggttggggggtgtgccctctctggttaccccgctctcgctgccactcataggcccgctgcccaggtatgcacaagtcaaggccttttctgcagaccaagtagccttccctggagagcgcccccagcaccacggaagctacctacatgccccgcggtggtcagcccgccttatcccagccccgagacctggagctggagaacccgcccgccagagtcgtagtagtggatggggagtagccgtcccattttcaacacatgtctcattctaaattgacgttttggtgggctggccgaagaaggagaaagacccgcggctccgacctctgacctgttaccccgctctcgctgccactcataggcccgctgcccaggtatgcacaagtcaaggccttttctgcagaccaagtagccttccctggagagcgcccccagcaccacggaaactacctacatgccccgcggtggtcagcccgccttatcccagccccgagacccaaaacaagaagcatggactgaatttgaggtttctggatggtcgtgtgaaccgaggggacgggtactggactgacaagaaatgagccttgaaggtcaatctgggtgacacccgagtctcctgatggagtttcactatgttgcccaggctgatctggaactcctgacctcaagcaatccacctgcctcagcctcccaaagtactgggattacaggagggagccaccgtgcccggcctggtcctgtgcattttatagataaggtaactgacaaacctagccacagtcaccccttcgccctaaaggagaactggaatttgaacccagagccttcttcaccaccatctccgttgtttctggaagcaccctccaggcaggccagccagcatcacggggcctcccctggggctggaacgtctgcaggatgcccctttgagaaatgctgttccacagaaccctgcctttcaggccttggagacgtgggcaggggagaagcagcgtccctcagagccaggcctggcagtggtgctagcaggggccaaggcccagggagcagggtctcctgtcggagggacctgggcaagcccctccacgcgccagcgggtttctcagcaggggaggtccacaccacaccgcttgggaacctgggtgcctaaacgcaacaggagccaaggcacaaatttaaccaaacaccaaggttgcgtgaggccccatttcatgagccgggctccaaggacgtgtccttaggcggctctggaaggcccagcgccagcccccgtcctctgttaaagggagccagccccgcggctccgcccaggcatggtagcctgagcgcgcccccagggtagtagggggcacctgaggagcagggtctgccctggcatgagcagagcccaggatggggtcagggtcaggccctgccagaggctggagggtgcccaaggcgaggccggtgaggcccagctctacaaataaagtgttttatttacagg

SEQ ID NO: 279599 - DNA, 1641 bp, Homo sapiens
tcgggtagcatgggtgttctgctagaggatgtgtctggctgggggcggtgtcccaatcgggagggttgccctgatgggggaggttctacagttgtggagatgccaacctggggggcgctccggttggggggtgtgccctctctggttaccccgctctcgctgccactcataggcccgctgcccaggtatgcacaagtcaaggccttttctgcagaccaagtagccttccctggagagcgcccccagcaccacggaagctacctacatgccccgcggtggtcagcccgccttatcccagccccgagacctggagctggagaacccgcccgccagagtcgtagtagtggatggggagtagccgtcccattttcaacacatgtctcattctaaattgacgttttggtgggctggccgaagaaggagaaagacccgcggctccgacctctgacctctaaccccggacgcactttgatttcgccggcttgcgcggaaggctgactccctgggccgcggcctggcgcgggagccgcctgtggggtgtccccggcgcgggagggtgctctggttcaggcccgctgcccaggtatgcacaagtcaaggccttttctgcagaccaagtagccttccctggagagcgcccccagcaccacggaaactacctacatgccccgcggtggtcagcccgccttatcccagccccgagacccgggacgggtactggactgacaagaaatgagccttgaaggtcaatctgggtgacacccgagtctcctgatggagtttcactatgttgcccaggctgatctggaactcctgacctcaagcaatccacctgcctcagcctcccaaagtactgggattacaggagggagccaccgtgcccggcctggtcctgtgcattttatagataaggtaactgacaaacctagccacagtcaccccttcgccctaaaggagaactggaatttgaacccagagccttcttcaccaccatctccgttgtttctggaagcaccctccaggcaggccagccagcatcacggggcctcccctggggctggaacgtctgcaggatgcccctttgagaaatgctgttccacagaaccctgcctttcaggccttggagacgtgggcaggggagaagcagcgtccctcagagccaggcctggcagtggtgctagcaggggccaaggcccagggagcagggtctcctgtcggagggacctgggcaagcccctccacgcgccagcgggtttctcagcaggggaggtccacaccacaccgcttgggaacctgggtgcctaaacgcaacaggagccaaggcacaaatttaaccaaacaccaaggttgcgtgaggccccatttcatgagccgggctccaaggacgtgtccttaggcggctctggaaggcccagcgccagcccccgtcctctgttaaagggagccagccccgcggctccgcccaggcatggtagcctgagcgcgcccccagggtagtagggggcacctgaggagcagggtctgccctggcatgagcagagcccaggatggggtcagggtcaggccctgccagaggctggagggtgcccaaggcgaggccggtgaggcccagctctacaaataaagtgttttatttacagg

SEQ ID NO: 279600 - DNA, 1725 bp, Homo sapiens
cgcgttggagctcgaccggtgcggcgcctgcgcactggaaccaggcgtgcggcgccccaggcgccgggcctgcggcggccggaaccggaacgcgcgcccgcggggtaggagacctggagctggagaacccgcccgccagagtcgtagtagtggatggggagtagccgtcccattttcaacacatgtctcattctaaattgacgttttggtgggctggccgaagaaggagaaagacccgcggctccgacctctgacctctaaccccggacgcactttgatttcgccggcttgcgcggaaggctgactccctgggccgcggcctggcgcgggagccgcctgtggggtgtccccggcgcgggagggtgctctggttcaggcaggttcccgttgcggcggggttccctcggttgggaggaatgcccctgccgagggtatgctccggctggagggggtgtccctaacggcgggaatacctggactggctggggtgtcccactggggagggtttcccggtggggaggtgtctggcgggggagcggctccggctaagcatgggtgttctgctaggaggatgtgtctggctgggggcggtgtcccaatcgggagggttgccctgatgggggaggttctacagttgtggagatgccaacctggggggcgctccggttggggggtgtgccctctctggttaccccgctctcgctgccactcataggcccgctgcccaggtatgcacaagtcaaggccttttctgcagaccaagtagccttccctggagagcgcccccagcaccacggaaactacctacatgccccgcggtggtcagcccgccttatcccagccccgagacccaaaacaagaagcatggactgaatttgaggtttctggatggtcgtgtgaaccgaggggacgggtactggactgacaagaaatgagccttgaaggtcaatctgggtgacacccgagtctcctggtgagtcggactccggagaattatctcaagtccagcatagacagcgcacatagacagaaaaggaaacggacaatcccaagtgccaagggaaccttcccaggtttctttagggcagctaaactgctctgtcaaagcctaagtccatttatgacaggccgagcaccctgagccctcgcaggagacacgagcgccttcatggccctcctgccccgcacccacctctccgccacccctgctgtctgtcccttccctgaaacctttatttcgagtgtctttgtggcttccctctttaccatccttgagttgaaatatcacctcttaagggaagccttccctctcctccctagttaaaatgatactgcccccccatacctgtcttcgttgacttacttggctccatcacagtgtgtgtcatgtgactctcccacatcctgatttggaatattgtctccctactagaatgtaagtccatggtgcctagaacaatacctggtgtacaggagacaaaatatttgttgactgggccgggtgcggtggctcacgcctgtaatcccagcactttgggaggccgaggtgggcagatcatgaggtcaggagatggagaccagcctggctaacatggtgaaaccccatctctactaaaaatacaaaaaatagccgggagtggtgctgggcgcctgtagtcccagctactcgggaggctgaggcaggagaatggcatgaacccgatcaaagaactcgggcctgtacca

SEQ ID NO: 279601 - DNA, 1114 bp, Homo sapiens
cgcgttggagctcgaccggtgcggcgcctgcgcactggaaccaggcgtgcggcgccccaggcgccgggcctgcggcggccggaaccggaacgcgcgcccgcggggtaggagacctggagctggagaacccgcccgccagagtcgtagtagtggatggggagtagccgtcccattttcaacacatgtctcattctaaattgacgttttggtgggctggccgaagaaggagaaagacccgcggctccgacctctgacctctaaccccggacgcactttgatttcgccggcttgcgcggaaggctgactccctgggccgcggcctggcgcgggagccgcctgtggggtgtccccggcgcgggagggtgctctggttcaggcaggttcccgttgcggcggggttccctcggttgggaggaatgcccctgccgagggtatgctccggctggagggggtgtccctaacggcgggaatacctggactggctggggtgtcccactggggagggtttcccggtggggaggtgtctggcgggggagcggctccggctaagcatgggtgttctgctaggaggatgtgtctggctgggggcggtgtcccaatcgggagggttgccctgatgggggaggttctacagttgtggagatgccaacctggggggcgctccggttggggggtgtgccctctctggttaccccgctctcgctgccactcataggcccgctgcccaggtatgcacaagtcaaggccttttctgcagaccaagtagccttccctggagagcgcccccagcaccacggaaactacctacatgccccgcggtggtcagcccgccttatcccagccccgagacccaaaacaagaagcatggactgaatttgaggtttctggatggtcgtgtgaaccgaggggacgggtactggactgacaagaaatgagccttgaaggtcaatctcgagccagctgtctcaatcgagcgagcgcttgtcctgatgggcaagcttccacattgtattggaaatgcatacctggggagcgctccggttggggggtgtgccctctctggttaacccgagcgctacccatgcaagtataatattaagtatgcatgacctcc

SEQ ID NO: 279602 - DNA, 1501 bp, Homo sapiens
cgcgttggagctcgaccggtgcggcgcctgcgcactggaaccaggcgtgcggcgccccaggcgccgggcctgcggcggccggaaccggaacgcgcgcccgcggggtaggagacctggagctggagaacccgcccgccagagtcgtagtagtggatggggagtagccgtcccattttcaacacatgtctcattctaaattgacgttttggtgggctggccgaagaaggagaaagacccgcggctccgacctctgacctctaaccccggacgcactttgatttcgccggcttgcgcggaaggctgactccctgggccgcggcctggcgcgggagccgcctgtggggtgtccccggcgcgggagggtgctctggttcaggcccgctgcccaggtatgcacaagtcaaggccttttctgcagaccaagtagccttccctggagagcgcccccagcaccacggaaactacctacatgccccgcggtggtcagcccgccttatcccagccccgagacccaaaacaagaagcatggactgaatttgaggtttctggatggtcgtgtgaaccgaggggacgggtactggactgacaagaaatgagccttgaaggtcaatctgggtgacacccgagtctcctgatggagtttcactatgttgcccaggctgatctggaactcctgacctcaagcaatccacctgcctcagcctcccaaagtactgggattacaggagggagccaccgtgcccggcctggtcctgtgcattttatagataaggtaactgacaaacctagccacagtcaccccttcgccctaaaggagaactggaatttgaacccagagccttcttcaccaccatctccgttgtttctggaagcaccctccaggcaggccagccagcatcacggggcctcccctggggctggaacgtctgcaggatgcccctttgagaaatgctgttccacagaaccctgcctttcaggccttggagacgtgggcaggggagaagcagcgtccctcagagccaggcctggcagtggtgctagcaggggccaaggcccagggagcagggtctcctgtcggagggacctgggcaagcccctccacgcgccagcgggtttctcagcaggggaggtccacaccacaccgcttgggaacctgggtgcctaaacgcaacaggagccaaggcacaaatttaaccaaacaccaaggttgcgtgaggccccatttcatgagccgggctccaaggacgtgtccttaggcggctctggaaggcccagcgccagcccccgtcctctgttaaagggagccagccccgcggctccgcccaggcatggtagcctgagcgcgcccccagggtagtagggggcacctgaggagcagggtctgccctggcatgagcagagcccaggatggggtcagggtcaggccctgccagaggctggagggtgcccaaggcgaggccggtgaggcccagctctacaaataaagtgttttatttacagg

SEQ ID NO: 279603 - DNA, 1840 bp, Homo sapiens
cgcgttggagctcgaccggtgcggcgcctgcgcactggaaccaggcgtgcggcgccccaggcgccgggcctgcggcggccggaaccggaacgcgcgcccgcggggtaggagacctggagctggagaacccgcccgccagagtcgtagtagtggatggggagtagccgtcccattttcaacacatgtctcattctaaattgacgttttggtgggctggccgaagaaggagaaagacccgcggctccgacctctgacctctaaccccggacgcactttgatttcgccggcttgcgcggaaggctgactccctgggccgcggcctggcgcgggagccgcctgtggggtgtccccggcgcgggagggtgctctggttcaggcaggttcccgttgcggcggggttccctcggttgggaggaatgcccctgccgagggtatgctccggctggagggggtgtccctaacggcgggaatacctggactggctggggtgtcccactggggagggtttcccggtggggaggtgtctggcgggggagcggctccggctaagcatgggtgttctgctaggaggatgtgtctggctgggggcggtgtcccaatcgggagggttgccctgatgggggaggttctacagttgtggagatgccaacctggggggcgctccggttggggggtgtgccctctctggttaccccgctctcgctgccactcataggcccgctgcccaggtatgcacaagtcaaggccttttctgcagaccaagtagccttccctggagagcgcccccagcaccacggaaactacctacatgccccgcggtggtcagcccgccttatcccagccccgagacccaaaacaagaagcatggactgaatttgaggtttctggatggtcgtgtgaaccgaggggacgggtactggactgacaagaaatgagccttgaaggtcaatctgggtgacacccgagtctcctgatggagtttcactatgttgcccaggctgatctggaactcctgacctcaagcaatccacctgcctcagcctcccaaagtactgggattacaggagggagccaccgtgcccggcctggtcctgtgcattttatagataaggtaactgacaaacctagccacagtcaccccttcgccctaaaggagaactggaatttgaacccagagccttcttcaccaccatctccgttgtttctggaagcaccctccaggcaggccagccagcatcacggggcctcccctggggctggaacgtctgcaggatgcccctttgagaaatgctgttccacagaaccctgcctttcaggccttggagacgtgggcaggggagaagcagcgtccctcagagccaggcctggcagtggtgctagcaggggccaaggcccagggagcagggtctcctgtcggagggacctgggcaagcccctccacgcgccagcgggtttctcagcaggggaggtccacaccacaccgcttgggaacctgggtgcctaaacgcaacaggagccaaggcacaaatttaaccaaacaccaaggttgcgtgaggccccatttcatgagccgggctccaaggacgtgtccttaggcggctctggaaggcccagcgccagcccccgtcctctgttaaagggagccagccccgcggctccgcccaggcatggtagcctgagcgcgcccccagggtagtagggggcacctgaggagcagggtctgccctggcatgagcagagcccaggatggggtcagggtcaggccctgccagaggctggagggtgcccaaggcgaggccggtgaggcccagctctacaaataaagtgttttatttacagg

SEQ ID NO: 279604 - DNA, 522 bp, Homo sapiens
tcttaaggctctaatatcttgtcttctggctatgagaacagagcatatggtttgcttgaagattcttgttcaacacttatccattaatctgacagcaggaagtgctaaagagcagaaacaggagtcggtcagactctcacctcaagtccaaggcaaatatgcttgcccctaaaagacatacttgatcttcaagttcaggaaaaccagatacaaagtctcactctgttgcccaggatggagtgcagtggtgcgatctcagctcactacaacctctgcctcccagggtcaagcgattctcctgcttcagcctccccagtagctgggactacaggtagcctcagcttgcacctgcatcagtcagtatttaccagccattctagacccttttaggatcctcaaacacacctcacaggactcaaaaggaagcgaactttcaccagttcgccaactgtcgtcaccaatctcatcactcaagagaaactcattcagcttttgaacactgcaaaaaacaataaacacaga

SEQ ID NO: 279605 - DNA, 807 bp, Homo sapiens
cagccagagattatgtgggcttttccatgggaagaaccactctacgttatcaccttctacatagtagcagttgaagccaaatggacagaaagcccgagacaacatgaagttgttctacaagttattttggagaaattgacttaccataccactcatcaacccatgcaaaagcctgtctatgtccaatcagcagaatgtctcggaccacctaaaaagtaaaagaaggagactgaaataatagcatctttgatgaaaactatctggaagacaagttgttaacaattctggggatcttggtgattacagagttcttaatccctctgtccataggtgatgacaattacaggctgcctataggtcctatagtgctcacacacctccagcccttccccatggtgtacacacacttgcagtatattcatctctttgtcttatttgagagtagggctgggtgtgtgtacaaactaatgacaaatacttgacagtcacacagcagtgatacaaataaatatctaggttaattaccttgaagtttttctctccatttatttttaactaaaacagcatctacttttcatctgtgggagggtgtgtctcactggtaccaggaggtcataaattttggaaatctagaacacttttctaggcagcaagtcactttttttttttttttttggaaacaaattcttactctgtcgccaagctggagtgcagtggcgcgatcttggctcacagcaacctcgtgcctccagggttcaagcaattctcctgcctcagcctcacaagtagctgggactacaggcgtgg

SEQ ID NO: 279606 - DNA, 1901 bp, Homo sapiens
ggcgcccgaggagaacgctgggacctaactcttgctgcagagtttggagcgccgctttctggcggcgcgcgcgctgcgctccttcccctggcagagcttagaagcaaaattaacagactcatcagattctgagcttctgcgggatattttgcagaagactgtgaagcatcctgtgtgtgtgacgcacccgccgtcagtcaagtatgcccggtgctttctctcagaactcatcaaaaagacgtgctgtattgcccagaagccatcgtgttgctggtcggggtcctgctgaggctggctgcctgccgggagcaccagcgggctcctgaggtctatgtggcctttactgtccgcaacccagagacatgccagctgttcaccaccgagctaggccaggccaggatcagatgggaagtggaacctcgtcatgaccagaaactgtttccctatgaagagcacttggagatggcaatgctgaacctcacactgtaggactcacacacgactccaatgggattgtgagaatcaagtcactctcaagggaagaggtttcatatgggaaagctgataaaactttcactggactggaatgtttggagaatgttaatttccaaatcaggaactacaaactgccctctaataagacatcggctatctaagcgtgtgggtgctccctttctgccagcagttctggttcttaaggaaatcgccatcactcagacatgaaaactctggctccaaaaatagcattttctttgtgcaaataaaaacgtgtgtatcaagtatgtggacacactcggttcctcacaaagccaagcccgctgcagctgccacatccctggacacactcggttcctcacaaagccaagactgctgcagctgccacatccgcggacacactcagttcttcacaaagccaagcccgctgcagctgccacatccctgggcttacgatgcagcaggtgcttttttcaagacaggaatcaaaatgttaggaacacggcagaaaggtgacacctggagaccaaacgcaggataaggagtactgcagaggtcacagggaagtcacagaacagtaatacgctagcaggggcatggggcatgaagaacagaagaagagaggaagtgtttccgagcctccggaaaagaaatcagagccaagcacagcttcccgggtcacagaaccaattcattcaccaggcggcaccactgccgtcatttcagcttctggccactgggaggcgctgctcaaaagggtttgccctgagactccgagaagaagctgcgggaaggacagcaggggtcccggggttttagcctctggcccaggagttgtatgtccataaccaaagggagcacagtctgcacccagctctcatcccatcggagctgctgcgactcccgcaggttcttccaaaactggtttagcttgcctgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagttcctaactccctcacttggactcgagactcttcacgccccagcagcgctccgcctccaacttgacatcatgctttctggaaacttccccgtatgtcccactttcccacacttggtgccctggagcacctcccggcctctaacgtgctgtatgttcccctgcgagcaccctcctcttggcctctggccaagtcccacccatctgtgggtaacaagggggtgtcggtgttcttttcagccttgctaaactctctgaatcaaggatcacaaactacagcctgcaggccaaatccagcccacagcctgtgtttgtaaataaagttttattggaac

SEQ ID NO: 279607 - DNA, 1688 bp, Homo sapiens
ggcgcccgaggagaacgctgggacctaactcttgctgcagagtttggagcgccgctttctggcggcgcgcgcgctgcgctccttcccctggcagactgtgaagcatcctgtgtgtgtgacgcacccgccgtcagtcaagtatgcccggtgctttctctcagaactcatcaaaaaggccaggccaggatcagatgggaagtggaacctcgtcatgaccagaaactgtttccctatgaagagcacttggagatggcaatgctgaacctcacactgtaggactcacacacgactccaatgggattgtgagaatcaagtcactctcaagggaagaggtttcatatgggaaagctgataaaactttcactggactggaatgtttggagaatgttaatttccaaatcaggaactacaaactgccctctaataagacatcggctatctaagcgtgtgggtgctccctttctgccagcagttctggttcttaaggaaatcgccatcactcagacatgaaaactctggctccaaaaatagcattttctttgtgcaaataaaaacgtgtgtatcaagtatgtggacacactcggttcctcacaaagccaagcccgctgcagctgccacatccctggacacactcggttcctcacaaagccaagactgctgcagctgccacatccgcggacacactcagttcttcacaaagccaagcccgctgcagctgccacatccctgggcttacgatgcagcaggtgcttttttcaagacaggaatcaaaatgttaggaacacggcagaaaggtgacacctggagaccaaacgcaggataaggagtactgcagaggtcacagggaagtcacagaacagtaatacgctagcaggggcatggggcatgaagaacagaagaagagaggaagtgtttccgagcctccggaaaagaaatcagagccaagcacagcttcccgggtcacagaaccaattcattcaccaggcggcaccactgccgtcatttcagcttctggccactgggaggcgctgctcaaaagggtttgccctgagactccgagaagaagctgcgggaaggacagcaggggtcccggggttttagcctctggcccaggagttgtatgtccataaccaaagggagcacagtctgcacccagctctcatcccatcggagctgctgcgactcccgcaggttcttccaaaactggtttagcttgcctgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagttcctaactccctcacttggactcgagactcttcacgccccagcagcgctccgcctccaacttgacatcatgctttctggaaacttccccgtatgtcccactttcccacacttggtgccctggagcacctcccggcctctaacgtgctgtatgttcccctgcgagcaccctcctcttggcctctggccaagtcccacccatctgtgggtaacaagggggtgtcggtgttcttttcagccttgctaaactctctgaatcaaggatcacaaactacagcctgcaggccaaatccagcccacagcctgtgtttgtaaataaagttttattggaac

SEQ ID NO: 279608 - DNA, 1670 bp, Homo sapiens
ggcgcccgaggagaacgctgggacctaactcttgctgcagagtttggagcgccgctttctggcggcgcgcgcgctgcgctccttcccctggcagagcttagaagcaaaattaacagactcatcagattctgagcttctgcgggatattttgcagaaggccaggccaggatcagatgggaagtggaacctcgtcatgaccagaaactgtttccctatgaagagcacttggagatggcaatgctgaacctcacactgtaggactcacacacgactccaatgggattgtgagaatcaagtcactctcaagggaagaggtttcatatgggaaagctgataaaactttcactggactggaatgtttggagaatgttaatttccaaatcaggaactacaaactgccctctaataagacatcggctatctaagcgtgtgggtgctccctttctgccagcagttctggttcttaaggaaatcgccatcactcagacatgaaaactctggctccaaaaatagcattttctttgtgcaaataaaaacgtgtgtatcaagtatgtggacacactcggttcctcacaaagccaagcccgctgcagctgccacatccctggacacactcggttcctcacaaagccaagactgctgcagctgccacatccgcggacacactcagttcttcacaaagccaagcccgctgcagctgccacatccctgggcttacgatgcagcaggtgcttttttcaagacaggaatcaaaatgttaggaacacggcagaaaggtgacacctggagaccaaacgcaggataaggagtactgcagaggtcacagggaagtcacagaacagtaatacgctagcaggggcatggggcatgaagaacagaagaagagaggaagtgtttccgagcctccggaaaagaaatcagagccaagcacagcttcccgggtcacagaaccaattcattcaccaggcggcaccactgccgtcatttcagcttctggccactgggaggcgctgctcaaaagggtttgccctgagactccgagaagaagctgcgggaaggacagcaggggtcccggggttttagcctctggcccaggagttgtatgtccataaccaaagggagcacagtctgcacccagctctcatcccatcggagctgctgcgactcccgcaggttcttccaaaactggtttagcttgcctgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagttcctaactccctcacttggactcgagactcttcacgccccagcagcgctccgcctccaacttgacatcatgctttctggaaacttccccgtatgtcccactttcccacacttggtgccctggagcacctcccggcctctaacgtgctgtatgttcccctgcgagcaccctcctcttggcctctggccaagtcccacccatctgtgggtaacaagggggtgtcggtgttcttttcagccttgctaaactctctgaatcaaggatcacaaactacagcctgcaggccaaatccagcccacagcctgtgtttgtaaataaagttttattggaac

SEQ ID NO: 279609 - DNA, 1999 bp, Homo sapiens
ggcgcccgaggagaacgctgggacctaactcttgctgcagagtttggagcgccgctttctggcggcgcgcgcgctgcgctccttcccctggcaggtgggcggcggggcgagcggagaggcccgcagggctcgcgggagtccaggggcagacgggatgggtctccgtgcagaagcccccgacacgcccgccacagcttagaagcaaaattaacagactcatcagattctgagcttctgcgggatattttgcagaagactgtgaagcatcctgtgtgtgtgacgcacccgccgtcagtcaagtatgcccggtgctttctctcagaactcatcaaaaagacgtgctgtattgcccagaagccatcgtgttgctggtcggggtcctgctgaggctggctgcctgccgggagcaccagcgggctcctgaggtctatgtggcctttactgtccgcaacccagagacatgccagctgttcaccaccgagctaggccaggccaggatcagatgggaagtggaacctcgtcatgaccagaaactgtttccctatgaagagcacttggagatggcaatgctgaacctcacactgtaggactcacacacgactccaatgggattgtgagaatcaagtcactctcaagggaagaggtttcatatgggaaagctgataaaactttcactggactggaatgtttggagaatgttaatttccaaatcaggaactacaaactgccctctaataagacatcggctatctaagcgtgtgggtgctccctttctgccagcagttctggttcttaaggaaatcgccatcactcagacatgaaaactctggctccaaaaatagcattttctttgtgcaaataaaaacgtgtgtatcaagtatgtggacacactcggttcctcacaaagccaagcccgctgcagctgccacatccctggacacactcggttcctcacaaagccaagactgctgcagctgccacatccgcggacacactcagttcttcacaaagccaagcccgctgcagctgccacatccctgggcttacgatgcagcaggtgcttttttcaagacaggaatcaaaatgttaggaacacggcagaaaggtgacacctggagaccaaacgcaggataaggagtactgcagaggtcacagggaagtcacagaacagtaatacgctagcaggggcatggggcatgaagaacagaagaagagaggaagtgtttccgagcctccggaaaagaaatcagagccaagcacagcttcccgggtcacagaaccaattcattcaccaggcggcaccactgccgtcatttcagcttctggccactgggaggcgctgctcaaaagggtttgccctgagactccgagaagaagctgcgggaaggacagcaggggtcccggggttttagcctctggcccaggagttgtatgtccataaccaaagggagcacagtctgcacccagctctcatcccatcggagctgctgcgactcccgcaggttcttccaaaactggtttagcttgcctgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagttcctaactccctcacttggactcgagactcttcacgccccagcagcgctccgcctccaacttgacatcatgctttctggaaacttccccgtatgtcccactttcccacacttggtgccctggagcacctcccggcctctaacgtgctgtatgttcccctgcgagcaccctcctcttggcctctggccaagtcccacccatctgtgggtaacaagggggtgtcggtgttcttttcagccttgctaaactctctgaatcaaggatcacaaactacagcctgcaggccaaatccagcccacagcctgtgtttgtaaataaagttttattggaac

SEQ ID NO: 279610 - DNA, 2134 bp, Homo sapiens
  misc_feature (1)..(1): n is a, c, g, or t
  misc_feature (10)..(10): n is a, c, g, or t
  misc_feature (13)..(13): n is a, c, g, or t
  misc_feature (17)..(17): n is a, c, g, or t
  misc_feature (29)..(31): n is a, c, g, or t
  misc_feature (52)..(52): n is a, c, g, or t
  misc_feature (66)..(67): n is a, c, g, or t
  misc_feature (83)..(83): n is a, c, g, or t
  misc_feature (88)..(88): n is a, c, g, or t
  misc_feature (92)..(92): n is a, c, g, or t
  misc_feature (146)..(146): n is a, c, g, or t
  misc_feature (162)..(162): n is a, c, g, or t
  misc_feature (166)..(166): n is a, c, g, or t
  misc_feature (171)..(171): n is a, c, g, or t
  misc_feature (173)..(173): n is a, c, g, or t
  misc_feature (184)..(184): n is a, c, g, or t
  misc_feature (192)..(192): n is a, c, g, or t
  misc_feature (197)..(197): n is a, c, g, or t
  misc_feature (204)..(204): n is a, c, g, or t
  misc_feature (207)..(207): n is a, c, g, or t
  misc_feature (211)..(211): n is a, c, g, or t
  misc_feature (218)..(218): n is a, c, g, or t
  misc_feature (256)..(256): n is a, c, g, or t
  misc_feature (320)..(320): n is a, c, g, or t
  misc_feature (322)..(323): n is a, c, g, or t
nttttttttnaanggantcttgctctgtnnncaggctggagtgcagtggcgngatctcagctcacnncaacctccgcctcccnggttnaagngattctcctgcctcagcctcccgagtagctgggactacaggcacgcgccaccangcccatttttgtattnttantagananggggtttcacnatgttggncaggntggtctnganctcntgacctngtgatccacccgcctaggcctcccgaagtgctgggatnacaggcgtgagccaccgcgccaggcctaatttattttcatttttagtaaagacgagggctcgcnannttgcccagcctggtctcgaactcctgagctcaagcgatgattcccgcctccgcctcccaaactgctagaattatatagccttagtttttgactctgtccagatcttcagtatggccccgcctctggagttgaccacgcctgtcattctgagcctcccttctaaccctgtccctgagttgactcagttgcttgagaattgactgctacctcccgccaacgctccttctccggcccgccaggcattctgattacgtccattttcacgtattccttatgtgaataccttcgaggcctccaagttggctgcacctcttggcatttgaccacgcccctacggccccgcccaacctttaagccacgcccttttcaacctggcagtgccccccgattttgatgtcaaagcttctggaatctggaatgcctccacctggtctcagcctctgttactccgtaccccagattttaatttcgcccaggcgaacactgtggctgcacccttaaattcctcagactccctctttccttgtagaaactctgtggctgctgccttgacttcatccctgaaactcaacggggcctctcctgtaccttaataaccacgcccataagccaagctcctccctgacttcctcacccagtagacctgaccgtccagcttctaaaaactctggccacgcccctcaatattgactccgccctcccagaccttccactgttaccgtgccacctcaagattggtccctccaaggctctggcaccgtccccgcttttgaactagctggccccactctaggttacgacctcgtggcctggggcatgactacatttctcgaccatttcctccctatctctttctgcggcttgacgccgccccagtccttacccttcctttttggcgctacagttgctgctggaggatgtggtccggctgcgggggtcctcacggcgcaccgaggcgaggcgctctggtgacaagtagcggcggacactgctaaaagagagcacacaggtcttggaagaggctgggggtcccggccttgtgccttacctgcgcccggaggtcgcctccttcttgggagaggatggggacgtggcatagccacccacgcgccgcgggggtcccgagccattaaggggcgtcctggtgggaaggcctttcaagagctgacacactggagggatggggttaggggacagaagagggcgacgcagagcatccgccagcgccgcctttaggaccgccagctcgtcttcctgtaactgcagccgctgctccagcgccgacacgcggtcgtccacttccataccgctcgtgcccgacaaattgtcatctggaagacgggggagtgccggctgcagggccacccaggagctccagtgcccaaggggtccctcccgccttcctgggtctaagcggggggccagccacgcccctttcctgtcccgctacctggggctgggacacttggacatgagccaaggaagaggactctgaagggggaaggaaatccccacagctctccaacccatccgcacactcctctctgccacagcgcgctggccgtgtgaccttggggaagtcccttccctcttattttctaagagtctgtgaacccaggagcctctcgctctggctttaagatgctatgactaagacgtgaccaggcgcagtggctcacgcctgtaaccccagcactttgggaggccgaggcgggcgtatcacgaggtcaggagatcgagaccatcctggccaacatggtgaaaccccgtctctactaaaataaaattaaattaaaaataaaataaaattt

SEQ ID NO: 279611 - DNA, 2398 bp, Homo sapiens
  misc_feature (1)..(1): n is a, c, g, or t
  misc_feature (10)..(10): n is a, c, g, or t
  misc_feature (13)..(13): n is a, c, g, or t
  misc_feature (17)..(17): n is a, c, g, or t
  misc_feature (29)..(31): n is a, c, g, or t
  misc_feature (52)..(52): n is a, c, g, or t
  misc_feature (66)..(67): n is a, c, g, or t
  misc_feature (83)..(83): n is a, c, g, or t
  misc_feature (88)..(88): n is a, c, g, or t
  misc_feature (92)..(92): n is a, c, g, or t
  misc_feature (146)..(146): n is a, c, g, or t
  misc_feature (162)..(162): n is a, c, g, or t
  misc_feature (166)..(166): n is a, c, g, or t
  misc_feature (171)..(171): n is a, c, g, or t
  misc_feature (173)..(173): n is a, c, g, or t
  misc_feature (184)..(184): n is a, c, g, or t
  misc_feature (192)..(192): n is a, c, g, or t
  misc_feature (197)..(197): n is a, c, g, or t
  misc_feature (204)..(204): n is a, c, g, or t
  misc_feature (207)..(207): n is a, c, g, or t
  misc_feature (211)..(211): n is a, c, g, or t
  misc_feature (218)..(218): n is a, c, g, or t
  misc_feature (256)..(256): n is a, c, g, or t
  misc_feature (320)..(320): n is a, c, g, or t
  misc_feature (322)..(323): n is a, c, g, or t
  misc_feature (1333)..(1333): n is a, c, g, or t
nttttttttnaanggantcttgctctgtnnncaggctggagtgcagtggcgngatctcagctcacnncaacctccgcctcccnggttnaagngattctcctgcctcagcctcccgagtagctgggactacaggcacgcgccaccangcccatttttgtattnttantagananggggtttcacnatgttggncaggntggtctnganctcntgacctngtgatccacccgcctaggcctcccgaagtgctgggatnacaggcgtgagccaccgcgccaggcctaatttattttcatttttagtaaagacgagggctcgcnannttgcccagcctggtctcgaactcctgagctcaagcgatgattcccgcctccgcctcccaaactgctagaattatatagccttagtttttgactctgtccagatcttcagtatggccccgcctctggagttgaccacgcctgtcattctgagcctcccttctaaccctgtccctgagttgactcagttgcttgagaattgactgctacctcccgccaacgctccttctccggcccgccaggcattctgattacgtccattttcacgtattccttatgtgaataccttcgaggcctccaagttggctgcacctcttggcatttgaccacgcccctacggccccgcccaacctttaagccacgcccttttcaacctggcagtgccccccgattttgatgtcaaagcttctggaatctggaatgcctccacctggtctcagcctctgttactccgtaccccagattttaatttcgcccaggcgaacactgtggctgcacccttaaattcctcagactccctctttccttgtagaaactctgtggctgctgccttgacttcatccctgaaactcaacggggcctctcctgtaccttaataaccacgcccataagccaagctcctccctgacttcctcacccagtagacctgaccgtccagcttctaaaaactctggccacgcccctcaatattgactccgccctcccagaccttccactgttaccgtgccacctcaagattggtccctccaaggctctggcaccgtccccgcttttgaactagctggccccactctaggttacgacctcgtggcctggggcatgactacatttctcgaccatttcctccctatctctttctgcggcttgacgccgccccagtccttacccttcctttttggcgctacagttgctgctggaggatgtggtccggctgcgggggtcctcacggcgcaccgaggcgaggcgctctggtgacaagtagcggcggacactgctaaaagagagcacacagntgggggcagagccttctaggccagcaggcgagtgccgtgagcaagcgagattctccctgcaccctctgctgctggagctcaggcaaacaaaccacctctgtctcccacgaggtcttggaagaggctgggggtcccggccttgtgccttacctgcgcccggaggtcgcctccttcttgggagaggatggggacgtggcatagccacccacgcgccgcgggggtcccgagccattaaggggcgtcctggtgggaaggcctttcaagagctgacacactggagggatggggttaggggacagaagagggtgagtataaggaccaggccccggtcctccccatcccacccctccagtctaacggggatacccgaggcagtggtgcctaagcgcggaggcgcccggcccttgggggtgccccgcgcgcgtagcgccgctccctgttcttcgcatgcccgcaggcgacgcagagcatccgccagcgccgcctttaggaccgccagctcgtcttcctgtaactgcagccgctgctccagcgccgacacgcggtcgtccacttccataccgctcgtgcccgacaaattgtcatctggaagacgggggagtgccggctgcagggccacccaggagctccagtgcccaaggggtccctcccgccttcctgggtctaagcggggggccagccacgcccctttcctgtcccgctacctggggctgggacacttggacatgagccaaggaagaggactctgaagggggaaggaaatccccacagctctccaacccatccgcacactcctctctgccacagcgcgctggccgtgtgaccttggggaagtcccttccctcttattttctaagagtctgtgaacccaggagcctctcgctctggctttaagatgctatgactaagacgtgaccaggcgcagtggctcacgcctgtaaccccagcactttgggaggccgaggcgggcgtatcacgaggtcaggagatcgagaccatcctggccaacatggtgaaaccccgtctctactaaaataaaattaaattaaaaataaaataaaattt

SEQ ID NO: 279612 - DNA, 1940 bp, Homo sapiens
  misc_feature (1)..(1): n is a, c, g, or t
  misc_feature (10)..(10): n is a, c, g, or t
  misc_feature (13)..(13): n is a, c, g, or t
  misc_feature (17)..(17): n is a, c, g, or t
  misc_feature (29)..(31): n is a, c, g, or t
  misc_feature (52)..(52): n is a, c, g, or t
  misc_feature (66)..(67): n is a, c, g, or t
  misc_feature (83)..(83): n is a, c, g, or t
  misc_feature (88)..(88): n is a, c, g, or t
  misc_feature (92)..(92): n is a, c, g, or t
  misc_feature (146)..(146): n is a, c, g, or t
  misc_feature (162)..(162): n is a, c, g, or t
  misc_feature (166)..(166): n is a, c, g, or t
  misc_feature (171)..(171): n is a, c, g, or t
  misc_feature (173)..(173): n is a, c, g, or t
  misc_feature (184)..(184): n is a, c, g, or t
  misc_feature (192)..(192): n is a, c, g, or t
  misc_feature (197)..(197): n is a, c, g, or t
  misc_feature (204)..(204): n is a, c, g, or t
  misc_feature (207)..(207): n is a, c, g, or t
  misc_feature (211)..(211): n is a, c, g, or t
  misc_feature (218)..(218): n is a, c, g, or t
  misc_feature (256)..(256): n is a, c, g, or t
  misc_feature (320)..(320): n is a, c, g, or t
  misc_feature (322)..(323): n is a, c, g, or t
nttttttttnaanggantcttgctctgtnnncaggctggagtgcagtggcgngatctcagctcacnncaacctccgcctcccnggttnaagngattctcctgcctcagcctcccgagtagctgggactacaggcacgcgccaccangcccatttttgtattnttantagananggggtttcacnatgttggncaggntggtctnganctcntgacctngtgatccacccgcctaggcctcccgaagtgctgggatnacaggcgtgagccaccgcgccaggcctaatttattttcatttttagtaaagacgagggctcgcnannttgcccagcctggtctcgaactcctgagctcaagcgatgattcccgcctccgcctcccaaactgctagaattatatagccttagtttttgactctgtccagatcttcagtatggccccgcctctggagttgaccacgcctgtcattctgagcctcccttctaaccctgtccctgagttgactcagttgcttgagaattgactgctacctcccgccaacgctccttctccggcccgccaggcattctgattacgtccattttcacgtattccttatgtgaataccttcgaggcctccaagttggctgcacctcttggcatttgaccacgcccctacggccccgcccaacctttaagccacgcccttttcaacctggcagtgccccccgattttgatgtcaaagcttctggaatctggaatgcctccacctggtctcagcctctgttactccgtaccccagattttaatttcgcccaggcgaacactgtggctgcacccttaaattcctcagactccctctttccttgtagaaactctgtggctgctgccttgacttcatccctgaaactcaacggggcctctcctgtaccttaataaccacgcccataagccaagctcctccctgacttcctcacccagtagacctgaccgtccagcttctaaaaactctggccacgcccctcaatattgactccgccctcccagaccttccactgttaccgtgccacctcaagattggtccctccaaggctctggcaccgtccccgcttttgaactagctggccccactctaggttacgacctcgtggcctggggcatgactacatttctcgaccatttcctccctatctctttctgcggcttgacgccgccccagtccttacccttcctttttggcgctacagttgctgctggaggatgtggtccggctgcgggggtcctcacggcgcaccgaggcgaggcgctctggtgacaagtagcggcggacactgctaaaagagagcacacaggcgacgcagagcatccgccagcgccgcctttaggaccgccagctcgtcttcctgtaactgcagccgctgctccagcgccgacacgcggtcgtccacttccataccgctcgtgcccgacaaattgtcatctggaagacgggggagtgccggctgcagggccacccaggagctccagtgcccaaggggtccctcccgccttcctgggtctaagcggggggccagccacgcccctttcctgtcccgctacctggggctgggacacttggacatgagccaaggaagaggactctgaagggggaaggaaatccccacagctctccaacccatccgcacactcctctctgccacagcgcgctggccgtgtgaccttggggaagtcccttccctcttattttctaagagtctgtgaacccaggagcctctcgctctggctttaagatgctatgactaagacgtgaccaggcgcagtggctcacgcctgtaaccccagcactttgggaggccgaggcgggcgtatcacgaggtcaggagatcgagaccatcctggccaacatggtgaaaccccgtctctactaaaataaaattaaattaaaaataaaataaaattt

SEQ ID NO: 279613 - DNA, 473 bp, Homo sapiens
gcaggatctgtgagaatgggcctgactgtgcaggctgcaatgtggagtaccagtcttgcaacaccaacccgtgtcctgagctgaagaagaccacgccctggacaccctggacacctgtcaacatctctgacaacggcggccactatgagcaacgattccgatacacatgcaaagcccgcctggctgatccgaatttgctggaagtgggaagacagagaatcgaaatgcggtactgttctagcgacggcaccagtggctgctccacagatgggctttctggggatttcctgcgtgctgggagatactctgcccacacggtcaacggggcttggtcagcctggacgtcgtggtcacagtgcagccgtgactgcagcaggggcattcggaaccggaagcgtgtttgcaacaaccccgaacccaagtatgggggaatgccttgccttggcccatctctggaataccaggaatgcaac

SEQ ID NO: 279614 - DNA, 456 bp, Homo sapiens
ataggcttttttttttttttgaggaaaaagaagaaagagaaagagacaaaggaaaaggagaaagacaagagaggaagaagcaggaggaaaacagtggagagaagaagaaaaaagagaaaaaataaattacagctatctgggcttccatgggagtgccaactctgacagctgagacatctctgacttggctctttcacctcttgtgcaagggaagaacagcactatttttaaaggaggtcattagtgagtcatgtttaagctcaatgcttagccatcatcgccatttgggtgcttgttgggaaggtcctaaattgagcggcctttgggcacagatctctgtgcactttgtttgccacttgctggctagctgatctggagactagttgaattttgcagtttttctgttttattttcctgacaaagcagtcgttccattaagaaaaaagcactcagcta

SEQ ID NO: 279615 - DNA, 1562 bp, Homo sapiens
cagctctcaaatctccaggcagcctctattgattgatctgagttggcagatgagttggcaggcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttcttctccttcatcccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaacttaaatgaaacagtgtcttttctccccctactctcccccaccccccatggtggaaatgatgatatccttaccatctgcacacttgcaggctgtgagtgggcagaaaaccagctggagatgcagcccatggcagggatacagatcctcagcttctgggaggtcctagaagctcacaatgccacccagctattggactatcatctctcatcatgtatattcaaagggaaaatgtacaacatttcttctaaactattttgtacagagaacatctccactatcatcaaaaagaggctgatgtgtagtagggagaaagtgttctggactaagtgtcaggaaacctcagtgcttcaggttctcttgcaattatgagactggttctgttacttcacctctctggagtttatttttcttatttgtatagtgaaggcctccagctttagcatctcataattttgttgtggaaaataaatacgtgcagaattaagagaataatgaaaagagtttgagggtatctcctctgccttaattgacaaactatgttaagggtagactatcacggtatccttcaaacatatctatgaggcaaggcttgtggcagaaaaggaagcaaaatgatatacttgtc

SEQ ID NO: 279616 - DNA, 1620 bp, Homo sapiens
tgaggcctccccagcaatgcagaactaagttacgaagacaaaagaggaatgacgactcagcatatgtaattatccagttgatatttatcttgttccagtcacctttagaaagctgtttggcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttcttctccttcatcccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaacttaaatgaaacagtgtcttttctccccctactctcccccaccccccatggtggaaatgatgatatccttaccatctgcacacttgcaggctgtgagtgggcagaaaaccagctggagatgcagcccatggcagggatacagatcctcagcttctgggaggtcctagaagctcacaatgccacccagctattggactatcatctctcatcatgtatattcaaagggaaaatgtacaacatttcttctaaactattttgtacagagaacatctccactatcatcaaaaagaggctgatgtgtagtagggagaaagtgttctggactaagtgtcaggaaacctcagtgcttcaggttctcttgcaattatgagactggttctgttacttcacctctctggagtttatttttcttatttgtatagtgaaggcctccagctttagcatctcataattttgttgtggaaaataaatacgtgcagaattaagagaataatgaaaagagtttgagggtatctcctctgccttaattgacaaactatgttaagggtagactatcacggtatccttcaaacatatctatgaggcaaggcttgtggcagaaaaggaagcaaaatgatatacttgtc

SEQ ID NO: 279617 - DNA, 1631 bp, Homo sapiens
tggcaggcagagagggagaaataacaagaatggaagagtcgttcttccaaaaagggccatctgtgaccctgagagataaacctggcagaccagggctcacatcttagtaaatcacctgtaaataaagcttgcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttcttctccttcatcccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaacttaaatgaaacagtgtcttttctccccctactctcccccaccccccatggtggaaatgatgatatccttaccatctgcacacttgcaggctgtgagtgggcagaaaaccagctggagatgcagcccatggcagggatacagatcctcagcttctgggaggtcctagaagctcacaatgccacccagctattggactatcatctctcatcatgtatattcaaagggaaaatgtacaacatttcttctaaactattttgtacagagaacatctccactatcatcaaaaagaggctgatgtgtagtagggagaaagtgttctggactaagtgtcaggaaacctcagtgcttcaggttctcttgcaattatgagactggttctgttacttcacctctctggagtttatttttcttatttgtatagtgaaggcctccagctttagcatctcataattttgttgtggaaaataaatacgtgcagaattaagagaataatgaaaagagtttgagggtatctcctctgccttaattgacaaactatgttaagggtagactatcacggtatccttcaaacatatctatgaggcaaggcttgtggcagaaaaggaagcaaaatgatatacttgtc

SEQ ID NO: 279618 - DNA, 1543 bp, Homo sapiens
  misc_feature (23)..(23): n is a, c, g, or t
  misc_feature (38)..(38): n is a, c, g, or t
  misc_feature (42)..(42): n is a, c, g, or t
ggatgtagtgcgccaccagcaanaaaaaaaaaaaatanttcngcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttcttctccttcatcccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaacttaaatgaaacagtgtcttttctccccctactctcccccaccccccatggtggaaatgatgatatccttaccatctgcacacttgcaggctgtgagtgggcagaaaaccagctggagatgcagcccatggcagggatacagatcctcagcttctgggaggtcctagaagctcacaatgccacccagctattggactatcatctctcatcatgtatattcaaagggaaaatgtacaacatttcttctaaactattttgtacagagaacatctccactatcatcaaaaagaggctgatgtgtagtagggagaaagtgttctggactaagtgtcaggaaacctcagtgcttcaggttctcttgcaattatgagactggttctgttacttcacctctctggagtttatttttcttatttgtatagtgaaggcctccagctttagcatctcataattttgttgtggaaaataaatacgtgcagaattaagagaataatgaaaagagtttgagggtatctcctctgccttaattgacaaactatgttaagggtagactatcacggtatccttcaaacatatctatgaggcaaggcttgtggcagaaaaggaagcaaaatgatatacttgtc

SEQ ID NO: 279619 - DNA, 1034 bp, Homo sapiens
cagctctcaaatctccaggcagcctctattgattgatctgagttggcagatgagttggcaggcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttcttctccttcatcccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaaactatggcctcgttggctacagcgtggagtgtgcggccgagcttaaattaatttgaggtcggtcgtgggtgatagataaaatgaattgagattaaaaa

SEQ ID NO: 279620 - DNA, 1866 bp, Homo sapiens
ataggcttttttttttttttgaggaaaaagaagaaagagaaagagacaaaggaaaaggagaaagacaagagaggaagaagcaggaggaaaacagtggagagaagaagaaaaaagagaaaaaataaattacagctatctgggcttccatgggagtgccaactctgacagctgagacatctctgacttggctctttcacctcttgtgcaagggaagaacagcactatttttaaaggaggtcattagttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttcttctccttcatcccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaacttaaatgaaacagtgtcttttctccccctactctcccccaccccccatggtggaaatgatgatatccttaccatctgcacacttgcaggctgtgagtgggcagaaaaccagctggagatgcagcccatggcagggatacagatcctcagcttctgggaggtcctagaagctcacaatgccacccagctattggactatcatctctcatcatgtatattcaaagggaaaatgtacaacatttcttctaaactattttgtacagagaacatctccactatcatcaaaaagaggctgatgtgtagtagggagaaagtgttctggactaagtgtcaggaaacctcagtgcttcaggttctcttgcaattatgagactggttctgttacttcacctctctggagtttatttttcttatttgtatagtgaaggcctccagctttagcatctcataattttgttgtggaaaataaatacgtgcagaattaagagaataatgaaaagagtttgagggtatctcctctgccttaattgacaaactatgttaagggtagactatcacggtatccttcaaacatatctatgaggcaaggcttgtggcagaaaaggaagcaaaatgatatacttgtc

SEQ ID NO: 279621 - DNA, 1748 bp, Homo sapiens
gctgcaaagatggccctgcctccatgccttgttgaacatgatgatgcccctgggaatgggaggtgatggttttttacttcggccctagtacagagtatgctcttgaagctggattccatcagcaggttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttcttctccttcatcccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaacttaaatgaaacagtgtcttttctccccctactctcccccaccccccatggtggaaatgatgatatccttaccatctgcacacttgcaggctgtgagtgggcagaaaaccagctggagatgcagcccatggcagggatacagatcctcagcttctgggaggtcctagaagctcacaatgccacccagctattggactatcatctctcatcatgtatattcaaagggaaaatgtacaacatttcttctaaactattttgtacagagaacatctccactatcatcaaaaagaggctgatgtgtagtagggagaaagtgttctggactaagtgtcaggaaacctcagtgcttcaggttctcttgcaattatgagactggttctgttacttcacctctctggagtttatttttcttatttgtatagtgaaggcctccagctttagcatctcataattttgttgtggaaaataaatacgtgcagaattaagagaataatgaaaagagtttgagggtatctcctctgccttaattgacaaactatgttaagggtagactatcacggtatccttcaaacatatctatgaggcaaggcttgtggcagaaaaggaagcaaaatgatatacttgtc

SEQ ID NO: 279622 - DNA, 1487 bp, Homo sapiens
  misc_feature (23)..(23): n is a, c, g, or t
  misc_feature (38)..(38): n is a, c, g, or t
  misc_feature (42)..(42): n is a, c, g, or t
ggatgtagtgcgccaccagcaanaaaaaaaaaaaatanttcngcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttcttctccttcatcccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaacttaaatgaaacagtgtcttttctccccctactctcccccaccccccatggtggaaatgatgatatccttaccatctgcacacttgcaggctgtgagtgggcagaaaaccagctggagatgcagcccatggcagggatacagatcctcagcttctgggaggtcctagaagctcacaatgccacccagctattggactatcatctctcatcatgtatattcaaagggaaaatgtacaacatttcttctaaactattttgtacagagaacatctccactatcatcaaaaagaggctgatgtgtagtagggagaaagtgttctggactaagtgtcaggaaacctcagtgcttcaggttctcttgcaattatgagactggttctgttacttcacctctctggagtttatttttcttatttgtatagtgaaggcctccagctttagcatctcataattttgttgtggaaaataaatacgtgcagaattaagagaataatgaaaagagtttgagggtatctcctctgccttaattgacaaactatgttaagggtagactatcacggtatccttcaaacatatctatgaggcaaggcttgtggcagaaaaggaagcaaaatgatatacttgtc

SEQ ID NO: 279623 - DNA, 301 bp, Homo sapiens
ttttttttggtttgatttcttttttattctttttccttaggtaattatccagttgatatttatcttgttccagtcacctttagaaagctgtttggtgagtacaatgttaatatagagacaatcagaatggtgtgtgcttttgtacaaaacttgtggatccatcaatgaggcatctgccattttttctttcttcccctctatattacaagttctggaatgcctgttctaattctccaaggagaattagaaaataaaaggcagagtctagagccatgtcaatatcctcccacagaatgtgtat

SEQ ID NO: 279624 - DNA, 969 bp, Homo sapiens
  misc_feature (841)..(841): n is a, c, g, or t
agcggtcttccggccggcgccccgccccctttactgacaggttgcccacctcccccaacgccaccccgcttcgcagtagacggacagaggagtcgtagcggtcgaggcttttgcggctccggcgtgccggaaagtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacttttctctaatttgaagganccttttttcccattgggtaagggcttccggtcgtcaaaagcggggtggggcggaacaattgggggcgcgaaaaggggcgggagaaaaaacataaggggggagcgggctggaggaaaaaaaaagtaggg

SEQ ID NO: 279625 - DNA, 650 bp, Homo sapiens
cgggctgcaggaattcggcacgatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacacttacttctcttaacttttgaaaggaatcccttattttttcacccaatttggtatattaacagcacatactcaaggttcactacaaaacaaacagttcctggtaatgatttaaatgtagttatagaaataaataatatgtatggagtcattacttctgaccttgaaatagcctgctggtgactggcattaacatacataactaactattcaattatttccattattaatgttgctgctgctacctttgggcctaaaaccaagtcacctgttgtgtatcaattaccttctttgataaaaggaaataaataaataatgttatcctatttttttgtcataaa

SEQ ID NO: 279626 - DNA, 1161 bp, Homo sapiens
agcggtcttccggccggcgccccgccccctttactgacaggttgcccacctcccccaacgccaccccgcttcgcagtagacggacagaggagtcgtagcggtcgaggcttttgcggctccggcgtgccggaaagtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacacttacttctcttaacttttgaaaggaatcccttattttttcacccaatttggtatattaacagcacatactcaaggttcactacaaaacaaacagttcctggtaatgatttaaatgtagttatagaaataaataatatgtatggagtcattacttctgaccttgaaatagcctgctggtgactggcattaacatacataactaactattcaattatttccattattaatgttgctgctgctacctttgggcctaaaaccaagtcacctgttgtgtatcaattaccttctttgataaaaggaaataaataaataatgttatcctatttttttgtcataaa

SEQ ID NO: 279627 - DNA, 896 bp, Homo sapiens
agcggtcttccggccggcgccccgccccctttactgacaggttgcccacctcccccaacgccaccccgcttcgcagtagacggacagaggagtcgtagcggtcgaggcttttgcggctccggcgtgccggaaagtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacacttacttctcttaacttttgaaaggaatcccttattttttcacctccttaatataaagtgggagtcctctagag

SEQ ID NO: 279628 - DNA, 1277 bp, Homo sapiens
aagcagtggtatcaacgcagagtgcccattacggccggggactgacaggttgcccacctcccccaacgccaccccgcttcgcagtagacggacagaggagtcgtagcggtcgaggcttttgcggctccggcgtgccggaaagaaaacgtcaattatgacagcaggtaattttatcggaagtgtttataactatatcccagtacgtggaacgaaaaagttatcaagaaatatttattgaatgtaaaaaaggtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacacttacttctcttaacttttgaaaggaatcccttattttttcacccaatttggtatattaacagcacatactcaaggttcactacaaaacaaacagttcctggtaatgatttaaatgtagttatagaaataaataatatgtatggagtcattacttctgaccttgaaatagcctgctggtgactggcattaacatacataactaactattcaattatttccattattaatgttgctgctgctacctttgggcctaaaaccaagtcacctgttgtgtatcaattaccttctttgataaaaggaaataaataaataatgttatcctatttttttgtcataaa

SEQ ID NO: 279629 - DNA, 1472 bp, Homo sapiens
aagcagtggtatcaacgcagagtgcccattacggccggggactgacaggttgcccacctcccccaacgccaccccgcttcgcagtagacggacagaggagtcgtagcggtcgaggcttttgcggctccggcgtgccggaaagtgcgtgagtgccgccgccggggagttttgttccatttcccggatcctggggtctggaggcgaaatatgctctgggcgaggaccaccgggtgtgggaagagggttctgagcgtctcctgacgttgacggtttatttcctagagtgtgttgggtctttctgtgagggtttcgagaaggaaacaggcatgcgactggttcatgcagcggacacccggtgggaggcctgggcctctgcggtttaatccagcagggggatggggctcattcggcaatttaaagagagaaataagttggctccagagggtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacacttacttctcttaacttttgaaaggaatcccttattttttcacccaatttggtatattaacagcacatactcaaggttcactacaaaacaaacagttcctggtaatgatttaaatgtagttatagaaataaataatatgtatggagtcattacttctgaccttgaaatagcctgctggtgactggcattaacatacataactaactattcaattatttccattattaatgttgctgctgctacctttgggcctaaaaccaagtcacctgttgtgtatcaattaccttctttgataaaaggaaataaataaataatgttatcctatttttttgtcataaa

SEQ ID NO: 279630 - DNA, 1252 bp, Homo sapiens
aagcagtggtatcaacgcagagtgcccattacggccggggactgacaggttgcccacctcccccaacgccaccccgcttcgcagtagacggacagaggagtcgtagcggtcgaggcttttgcggctccggcgtgccggaaagtatgttatgcataaaagtggataatttacatgataaatgaaaatggccaattctttaagaggagaagtactaaaactttataaaaatgtaagtaattatgttgccaattttataaaaatgttattatatgacatggattgtttagaaatatataatctttctttttgaagctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacacttacttctcttaacttttgaaaggaatcccttattttttcacccaatttggtatattaacagcacatactcaaggttcactacaaaacaaacagttcctggtaatgatttaaatgtagttatagaaataaataatatgtatggagtcattacttctgaccttgaaatagcctgctggtgactggcattaacatacataactaactattcaattatttccattattaatgttgctgctgctacctttgggcctaaaaccaagtcacctgttgtgtatcaattaccttctttgataaaaggaaataaataaataatgttatcctatttttttgtcataaa

SEQ ID NO: 279631 - DNA, 1360 bp, Homo sapiens
aagcagtggtatcaacgcagagtgcccattacggccggggactgacaggttgcccacctcccccaacgccaccccgcttcgcagtagacggacagaggagtcgtagcggtcgaggcttttgcggctccggcgtgccggaaagaaaacgtcaattatgacagcaggtaattttatcggaagtgtttataactatatcccagtacgtggaacgaaaaagttatcaagaaatatttattgaatgtaaaaaaggtatgttatgcataaaagtggataatttacatgataaatgaaaatggccaattctttaagaggagaagtactaaaactttataaaaatgtaagtaattatgttgccaattttataaaaatgttattatatgacatggattgtttagaaatatataatctttctttttgaagctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacacttacttctcttaacttttgaaaggaatcccttattttttcacccaatttggtatattaacagcacatactcaaggttcactacaaaacaaacagttcctggtaatgatttaaatgtagttatagaaataaataatatgtatggagtcattacttctgaccttgaaatagcctgctggtgactggcattaacatacataactaactattcaattatttccattattaatgttgctgctgctacctttgggcctaaaaccaagtcacctgttgtgtatcaattaccttctttgataaaaggaaataaataaataatgttatcctatttttttgtcataaa

SEQ ID NO: 279632 - DNA, 1181 bp, Homo sapiens
agcgggagagagagcgggaggggctgttgcttgacgagaaggcggactgccccgctgtcaccccggaacttataagtacaagggacacgacggcgcttcggtggcgcgttcgagtgttccggaaccagaccagggaagctaccgtgtctgctgtcgtgcgttggagctgaatcgttggcgtgcaggagtgagcaatgggcggtcgtccgaggtaagagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacacttacttctcttaacttttgaaaggaatcccttattttttcacccaatttggtatattaacagcacatactcaaggttcactacaaaacaaacagttcctggtaatgatttaaatgtagttatagaaataaataatatgtatggagtcattacttctgaccttgaaatagcctgctggtgactggcattaacatacataactaactattcaattatttccattattaatgttgctgctgctacctttgggcctaaaaccaagtcacctgttgtgtatcaattaccttctttgataaaaggaaataaataaataatgttatcctatttttttgtcataaa

SEQ ID NO: 279633 - DNA, 4993 bp, Homo sapiens
ggatggggaaggtctccggccccaggcgcggcgcgcggggcttctgcccagtttcctgcttctcagccgcggtgtctgccccggcccagagcagtctgtgcaatttagaaactcgataggaggcagcagctggtctcccaccaccctaaaaataatccgttccggcgcactgcgtgtttcgcctaggggaggaaaactgtcatcggagagttctgcgtccgggtttgaaatttacatcttaagacagtgtaggaagtcggtgttttgaaggtagctcaagtgcaccggcaggggtttgaagcagcgtgaagctattgcccaagagtaaaccatataagaagaaatgagcctttcattttgtggtaacaacatttcttcatataatatcaacgatggtgtactacaaaattcctgctttgtggatgccctcaacctggtccctcatgtctttctgttgtttatcacttttccaatattgtttattgggtgggggagccaaagctcaaaagtacaaattcaccacaacacatggcttcattttccgggacataacctgagatggattcttacattcgctctcctgtttgtgcatgtctgtgaaatagcagaaggcattgtttcagactcgcggcgggaatcaaggcacctccacctctttatgccagccgtgatgggattcgttgccactacaacatcgatagtgtattatcataatatcgaaacatcaaattttcctaaattacttttagccctgttcctgtattgggtaatggcctttattacaaaaacaataaaattggttaagtactgtcagtctggcttggacatatcaaacctgcgtttctgcatcacaggcatgatggtcatcttgaatgggctcttgatggctgtggagatcaatgtcattcgagtcaggagatatgtatttttcatgaatcctcagaaagtaaagcctcctgaagacctccaggatctgggagtgagatttcttcaaccatttgtgaatttgctgtcaaaagcaacatactggtggatgaacacacttattatatctgctcacaaaaagcctattgatctgaaggcaattggaaaattgccaatagcaatgagagcagtaacaaattatgtttgcctgaaagatgcatatgaagaacaaaagaaaaaagttgcagatcatccaaatcggactccatctatatggcttgcaatgtacagagcttttgggcgaccaattctacttagtagcacattccgctatctggctgatttactgggttttgctggacctctttgtatttctggaatagttcagcgtgtgaatgaaacccagaatgggacaaataacacaactggaatttcagaaaccctctcatcaaaggaatttcttgaaaacgcttacgttctagcagttcttctcttcttggctcttattctgcaaaggacatttttgcaggcttcctactatgtaaccatagagactggcattaacctccgtggagctctgctggccatgatttataataaaatccttaggctctctacgtctaacttatccatgggggagatgactctggggcagatcaacaacttagtcgccattgaaactaatcaactcatgtggtttttgttcctgtgtcccaatctatgggctatgcctgttcagatcataatgggcgtgattctgctctataatttacttggatcaagtgcattggtcggtgcagctgtcattgtgctccttgcgccaattcagtactttattgctacaaagttggcagaggctcagaaaagtacacttgattattccactgagagactcaagaaaacaaatgaaatattgaaaggcatcaaacttctaaaattgtatgcctgggaacacattttctgcaaaagtgtggaggaaacaagaatgaaagaactatctagtctcaaaacctttgcactatatacatcactctccatcttcatgaatgcagcaattcccatagcagctgttcttgctacatttgtgacccatgcgtatgccagtggaaacaatctgaaacctgcagaggcctttgcttcactgtctctcttccatatcctggtcacaccactgtccctgctcttcacggtggtcagatttgcagtcaaagccatcataagtgttcaaaagctgaatgagtttctcttgagtgatgagattggtgacgacagttggcgaactggtgaaagttcgcttccttttgagtcctgtaagaagcacactggagttcagccaaaaactataaacaggaaacagcctggaagatatcacctggacagctatgagcaatcaacacggcgtctacgtcccgcagaaacagaggacattgcaataaaggtcacaaatggatacttttcatggggcagtggtttagctacattatccaatatagatattcgaattccaacaggtcagttaaccatgattgtgggccaagtaggatgtgggaagtcctctcttctccttgccatcctcggtgagatgcagacattggaaggaaaagttcactggagcaatgtaaatgaatctgagccttcttttgaagcaaccagaagtaggaacaggtactctgtggcatatgcagctcaaaagccttggctattaaatgctacagtagaagaaaatattacttttggaagtccttttaacaaacagaggtacaaagctgtcacagatgcctgttctcttcagccagatattgacttattaccatttggagatcaaactgaaattggagagaggggcatcaacctgagtgggggacagaggcagagaatctgtgtggcacgagcgctgtatcaaaacaccaacattgtctttttggatgatccattctcagccctggacattcacttgagtgatcatttaatgcaggaggggattttgaaattcctgcaagatgacaaaaggacactcgttcttgtgactcacaaattacagtatctgacgcatgctgactggatcatagccatgaaagatggaagtgtcctaagagaaggaactttgaaggacattcaaaccaaagatgttgagctttatgaacactggaaaacacttatgaatcggcaagatcaagaattagaaaaggatatggaagctgaccaaactactttagagaggaaaactctccgacgggccatgtattcaagagaagccaaagcccagatggaggacgaagacgaagaggaagaagaggaggaagatgaggatgataacatgtccactgtaatgaggctcaggactaaaatgccatggaaaacctgctggcgctacctgacatctggaggattcttcctgctcatcctgatgattttctctaagcttttgaagcattcggtcattgtagctatagactattggctggccacatggacatcggagtacagtataaacaatactggaaaagctgatcagacctactatgtggctggctttagcatactctgtggagcaggcattttcctttgccttgttacatccctcactgtagaatggatgggtctcacagctgccaaaaatcttcaccacaaccttctcaataagataatccttggaccaataaggttttttgataccacacccctgggactgattctcaatcgcttttcagctgatactaatatcattgatcagcacatccctccaaccttggaatctctaactcgctcaacactgctctgcctgtctgccattgggatgatttcttatgctactcctgtgttcctggttgctctcctgccccttggtgttgccttttattttatccagaaatactttcgggttgcctctaaggacctccaggaactcgacgatagtacccagctccctctgctctgtcacttctcagaaacagcagaaggactcaccaccattcgggcctttaggcatgaaaccagatttaaacaacgtatgctggaactgacggatacaaacaacattgcctacttatttctctcagctgccaacagatggctggaggtcaggacggattatctgggagcttgcattgtcctcactgcatctatagcatccattagtgggtcttccaattctggattggtaggcttgggtcttctgtatgcacttacgataaccaattatttgaattgggttgtgaggaacttggctgacctggaggtccagatgggtgcagtgaagaaggtgaacagtttcctgactatggagtcagagaactatgaaggcacaatggatccttctcaagttccagaacattggccacaagaaggggagatcaagatacatgatctgtgtgtcagatatgaaaataatctgaaacctgttcttaagcacgtcaaggcttacatcaaacctggacaaaaggtgggcatatgtggtcgcactggcagtgggaaatcatcgttatctctggctttcttcagaatggttgatatatttgatggaaaaattgtcattgatgggatagacatttccaaattaccactgcacacactacgttctagactttcaatcattctgcaggatccaatactattcagtggttccattagatttaatttagatccagagtgcaaatgcacagatgacagactctgggaagccttagaaattgctcagctgaagaatatggtcaaatctctacctggaggtctagatgcggttgtcactgaaggtggggagaattttagcgtgggacagagacagctattttgccttgccagggcctttgtccgcaaaagcagcattcttattatggatgaggcaacagcttccattgacatggccacagagaatattttgcaaaaagtagtaatgacagcctttgcagaccggaccgtggtgacaatggctcaccgtgtctcttctattatggatgcaggccttgttttagtcttttctgagggtattttagtggagtgtgatactgtcccaaatttgttcgcccacaagaatggccccttttccactttggtgatgaccaacaagtag

SEQ ID NO: 279634 - DNA, 4885 bp, Homo sapiens
ggatggggaaggtctccggccccaggcgcggcgcgcggggcttctgcccagtttcctgcttctcagccgcggtgtctgccccggcccagagcagtctgtgcaatttagaaactcgataggaggcagcagctggtctcccaccaccctaaaaataatccgttccggcgcactgcgtgtttcgcctaggggaggaaaactgtcatcggagagttctgcgtccgggtttgaaatttacatcttaagacagtgtaggaagtcggtgttttgaaggtagctcaagtgcaccggcaggggtttgaagcagcgtgaagctattgcccaagagtaaaccatataagaagaaatgagcctttcattttgtggtaacaacatttcttcatataatatcaacgatggtgtactacaaaattcctgctttgtggatgccctcaacctggtccctcatgtctttctgttgtttatcacttttccaatattgtttattgggtgggggagccaaagctcaaaagtacaaattcaccacaacacatggcttcattttccgggacataacctgagatggattcttacattcgctctcctgtttgtgcatgtctgtgaaatagcagaaggcattgtttcagactcgcggcgggaatcaaggcacctccacctctttatgccagccgtgatgggattcgttgccactacaacatcgatagtgtattatcataatatcgaaacatcaaattttcctaaattacttttagccctgttcctgtattgggtaatggcctttattacaaaaacaataaaattggttaagtactgtcagtctggcttggacatatcaaacctgcgtttctgcatcacaggcatgatggtcatcttgaatgggctcttgatggctgtggagatcaatgtcattcgagtcaggagatatgtatttttcatgaatcctcagaaagtaaagcctcctgaagacctccaggatctgggagtgagatttcttcaaccatttgtgaatttgctgtcaaaagcaacatactggtggatgaacacacttattatatctgctcacaaaaagcctattgatctgaaggcaattggaaaattgccaatagcaatgagagcagtaacaaattatgtttgcctgaaagatgcatatgaagaacaaaagaaaaaagttgcagatcatccaaatcggactccatctatatggcttgcaatgtacagagcttttgggcgaccaattctacttagtagcacattccgctatctggctgatttactgggttttgctggacctctttgtatttctggaatagttcagcgtgtgaatgaaacccagaatgggacaaataacacaactggaatttcagaaaccctctcatcaaaggaatttcttgaaaacgcttacgttctagcagttcttctcttcttggctcttattctgcaaaggacatttttgcaggcttcctactatgtaaccatagagactggcattaacctccgtggagctctgctggccatgatttataataaaatccttaggctctctacgtctaacttatccatgggggagatgactctggggcagatcaacaacttagtcgccattgaaactaatcaactcatgtggtttttgttcctgtgtcccaatctatgggctatgcctgttcagatcataatgggcgtgattctgctctataatttacttggatcaagtgcattggtcggtgcagctgtcattgtgctccttgcgccaattcagtactttattgctacaaagttggcagaggctcagaaaagtacacttgattattccactgagagactcaagaaaacaaatgaaatattgaaaggcatcaaacttctaaaattgtatgcctgggaacacattttctgcaaaagtgtggaggaaacaagaatgaaagaactatctagtctcaaaacctttgcactatatacatcactctccatcttcatgaatgcagcaattcccatagcagctgttcttgctacatttgtgacccatgcgtatgccagtggaaacaatctgaaacctgcagaggcctttgcttcactgtctctcttccatatcctggtcacaccactgtccctgctcttcacggtggtcagatttgcagtcaaagccatcataagtgttcaaaagctgaatgagtttctcttgagtgatgagattggtgacgacagttggcgaactggtgaaagttcgcttccttttgagtcctgtaagaagcacactggagttgtcacaaatggatacttttcatggggcagtggtttagctacattatccaatatagatattcgaattccaacaggtcagttaaccatgattgtgggccaagtaggatgtgggaagtcctctcttctccttgccatcctcggtgagatgcagacattggaaggaaaagttcactggagcaatgtaaatgaatctgagccttcttttgaagcaaccagaagtaggaacaggtactctgtggcatatgcagctcaaaagccttggctattaaatgctacagtagaagaaaatattacttttggaagtccttttaacaaacagaggtacaaagctgtcacagatgcctgttctcttcagccagatattgacttattaccatttggagatcaaactgaaattggagagaggggcatcaacctgagtgggggacagaggcagagaatctgtgtggcacgagcgctgtatcaaaacaccaacattgtctttttggatgatccattctcagccctggacattcacttgagtgatcatttaatgcaggaggggattttgaaattcctgcaagatgacaaaaggacactcgttcttgtgactcacaaattacagtatctgacgcatgctgactggatcatagccatgaaagatggaagtgtcctaagagaaggaactttgaaggacattcaaaccaaagatgttgagctttatgaacactggaaaacacttatgaatcggcaagatcaagaattagaaaaggatatggaagctgaccaaactactttagagaggaaaactctccgacgggccatgtattcaagagaagccaaagcccagatggaggacgaagacgaagaggaagaagaggaggaagatgaggatgataacatgtccactgtaatgaggctcaggactaaaatgccatggaaaacctgctggcgctacctgacatctggaggattcttcctgctcatcctgatgattttctctaagcttttgaagcattcggtcattgtagctatagactattggctggccacatggacatcggagtacagtataaacaatactggaaaagctgatcagacctactatgtggctggctttagcatactctgtggagcaggcattttcctttgccttgttacatccctcactgtagaatggatgggtctcacagctgccaaaaatcttcaccacaaccttctcaataagataatccttggaccaataaggttttttgataccacacccctgggactgattctcaatcgcttttcagctgatactaatatcattgatcagcacatccctccaaccttggaatctctaactcgctcaacactgctctgcctgtctgccattgggatgatttcttatgctactcctgtgttcctggttgctctcctgccccttggtgttgccttttattttatccagaaatactttcgggttgcctctaaggacctccaggaactcgacgatagtacccagctccctctgctctgtcacttctcagaaacagcagaaggactcaccaccattcgggcctttaggcatgaaaccagatttaaacaacgtatgctggaactgacggatacaaacaacattgcctacttatttctctcagctgccaacagatggctggaggtcaggacggattatctgggagcttgcattgtcctcactgcatctatagcatccattagtgggtcttccaattctggattggtaggcttgggtcttctgtatgcacttacgataaccaattatttgaattgggttgtgaggaacttggctgacctggaggtccagatgggtgcagtgaagaaggtgaacagtttcctgactatggagtcagagaactatgaaggcacaatggatccttctcaagttccagaacattggccacaagaaggggagatcaagatacatgatctgtgtgtcagatatgaaaataatctgaaacctgttcttaagcacgtcaaggcttacatcaaacctggacaaaaggtgggcatatgtggtcgcactggcagtgggaaatcatcgttatctctggctttcttcagaatggttgatatatttgatggaaaaattgtcattgatgggatagacatttccaaattaccactgcacacactacgttctagactttcaatcattctgcaggatccaatactattcagtggttccattagatttaatttagatccagagtgcaaatgcacagatgacagactctgggaagccttagaaattgctcagctgaagaatatggtcaaatctctacctggaggtctagatgcggttgtcactgaaggtggggagaattttagcgtgggacagagacagctattttgccttgccagggcctttgtccgcaaaagcagcattcttattatggatgaggcaacagcttccattgacatggccacagagaatattttgcaaaaagtagtaatgacagcctttgcagaccggaccgtggtgacaatggctcaccgtgtctcttctattatggatgcaggccttgttttagtcttttctgagggtattttagtggagtgtgatactgtcccaaatttgttcgcccacaagaatggccccttttccactttggtgatgaccaacaagtag

SEQ ID NO: 279635 - DNA, 458 bp, Homo sapiens
ctcataagtttgccactataattgcaggtaagcctttcaggacttaccaaaagcaagtattgttttaattagggagttttggatgaagtcattgttatcatagttacaatggacatactggcatagcagaatatgttaggtttctaggactgaatgtacgcatgtgtgacactttttccagctttctctaaagaactcctttctttgcacagacatttgtgacccatgcgtatgccagtggaaacaatctgaaacctgcagaggcctttgcttcactgtctctcttccatatcctggtcacaccactgtccctgctcttcacggtggtcagatttgcagtcaaagccatcataaggtatgcactgaagtgtctggcattttttgcttattgataatagaaatgacgtgtgctaataggagtatttgaaaaaatataaaaaagaacattaaaatcactg

SEQ ID NO: 279636 - DNA, 608 bp, Homo sapiens
ggatggggaaggtctccggccccaggcgcggcgcgcggggcttctgcccagtttcctgcttctcagccgcggtgtctgccccggcccagagcagtctgtgcaatttagaaactcgataggaggcagcagctggtctcccaccaccctaaaaataatccgttccggcgcactgcgtgtttcgcctaggggaggaaaactgtcatcggagagttctgcgtccgggtttgaaatttacatcttaagacagtgtaggaagtcggtgttttgaaggtagctcaagtgcaccggcaggggtttgaagcagcgtgaagctattgcccaagagtaaaccatataagaagaaatgagcctttcattttgtggtaacaacatttcttcatataatatcaacgatggtgtactacaaaattcctgctttgtggatgccctcaacctggtccctcatgtctttctgttgtttatcacttttccaatattgtttattgatggattcttacattcgctctcctgtttgtgcatgtctgtgaaatagcagaaggcattgtttcagactcgtaagtgatctaagttaaataataccactgcagtataccagtgggtatattgat

SEQ ID NO: 279637 - DNA, 4993 bp, Homo sapiens
ggatggggaaggtctccggccccaggcgcggcgcgcggggcttctgcccagtttcctgcttctcagccgcggtgtctgccccggcccagagcagtctgtgcaatttagaaactcgataggaggcagcagctggtctcccaccaccctaaaaataatccgttccggcgcactgcgtgtttcgcctaggggaggaaaactgtcatcggagagttctgcgtccgggtttgaaatttacatcttaagacagtgtaggaagtcggtgttttgaaggtagctcaagtgcaccggcaggggtttgaagcagcgtgaagctattgcccaagagtaaaccatataagaagaaatgagcctttcattttgtggtaacaacatttcttcatataatatcaacgatggtgtactacaaaattcctgctttgtggatgccctcaacctggtccctcatgtctttctgttgtttatcacttttccaatattgtttattgggtgggggagccaaagctcaaaagtacaaattcaccacaacacatggcttcattttccgggacataacctgagatggattcttacattcgctctcctgtttgtgcatgtctgtgaaatagcagaaggcattgtttcagactcgcggcgggaatcaaggcacctccacctctttatgccagccgtgatgggattcgttgccactacaacatcgatagtgtattatcataatatcgaaacatcaaattttcctaaattacttttagccctgttcctgtattgggtaatggcctttattacaaaaacaataaaattggttaagtactgtcagtctggcttggacatatcaaacctgcgtttctgcatcacaggcatgatggtcatcttgaatgggctcttgatggctgtggagatcaatgtcattcgagtcaggagatatgtatttttcatgaatcctcagaaagtaaagcctcctgaagacctccaggatctgggagtgagatttcttcaaccatttgtgaatttgctgtcaaaagcaacatactggtggatgaacacacttattatatctgctcacaaaaagcctattgatctgaaggcaattggaaaattgccaatagcaatgagagcagtaacaaattatgtttgcctgaaagatgcatatgaagaacaaaagaaaaaagttgcagatcatccaaatcggactccatctatatggcttgcaatgtacagagcttttgggcgaccaattctacttagtagcacattccgctatctggctgatttactgggttttgctggacctctttgtatttctggaatagttcagcgtgtgaatgaaacccagaatgggacaaataacacaactggaatttcagaaaccctctcatcaaaggaatttcttgaaaacgcttacgttctagcagttcttctcttcttggctcttattctgcaaaggacatttttgcaggcttcctactatgtaaccatagagactggcattaacctccgtggagctctgctggccatgatttataataaaatccttaggctctctacgtctaacttatccatgggggagatgactctggggcagatcaacaacttagtcgccattgaaactaatcaactcatgtggtttttgttcctgtgtcccaatctatgggctatgcctgttcagatcataatgggcgtgattctgctctataatttacttggatcaagtgcattggtcggtgcagctgtcattgtgctccttgcgccaattcagtactttattgctacaaagttggcagaggctcagaaaagtacacttgattattccactgagagactcaagaaaacaaatgaaatattgaaaggcatcaaacttctaaaattgtatgcctgggaacacattttctgcaaaagtgtggaggaaacaagaatgaaagaactatctagtctcaaaacctttgcactatatacatcactctccatcttcatgaatgcagcaattcccatagcagctgttcttgctacatttgtgacccatgcgtatgccagtggaaacaatctgaaacctgcagaggcctttgcttcactgtctctcttccatatcctggtcacaccactgtccctgctcttcacggtggtcagatttgcagtcaaagccatcataagtgttcaaaagctgaatgagtttctcttgagtgatgagattggtgacgacagttggcgaactggtgaaagttcgcttccttttgagtcctgtaagaagcacactggagttcagccaaaaactataaacaggaaacagcctggaagatatcacctggacagctatgagcaatcaacacggcgtctacgtcccgcagaaacagaggacattgcaataaaggtcacaaatggatacttttcatggggcagtggtttagctacattatccaatatagatattcgaattccaacaggtcagttaaccatgattgtgggccaagtaggatgtgggaagtcctctcttctccttgccatcctcggtgagatgcagacattggaaggaaaagttcactggagcaatgtaaatgaatctgagccttcttttgaagcaaccagaagtaggaacaggtactctgtggcatatgcagctcaaaagccttggctattaaatgctacagtagaagaaaatattacttttggaagtccttttaacaaacagaggtacaaagctgtcacagatgcctgttctcttcagccagatattgacttattaccatttggagatcaaactgaaattggagagaggggcatcaacctgagtgggggacagaggcagagaatctgtgtggcacgagcgctgtatcaaaacaccaacattgtctttttggatgatccattctcagccctggacattcacttgagtgatcatttaatgcaggaggggattttgaaattcctgcaagatgacaaaaggacactcgttcttgtgactcacaaattacagtatctgacgcatgctgactggatcatagccatgaaagatggaagtgtcctaagagaaggaactttgaaggacattcaaaccaaagatgttgagctttatgaacactggaaaacacttatgaatcggcaagatcaagaattagaaaaggatatggaagctgaccaaactactttagagaggaaaactctccgacgggccatgtattcaagagaagccaaagcccagatggaggacgaagacgaagaggaagaagaggaggaagatgaggatgataacatgtccactgtaatgaggctcaggactaaaatgccatggaaaacctgctggcgctacctgacatctggaggattcttcctgctcatcctgatgattttctctaagcttttgaagcattcggtcattgtagctatagactattggctggccacatggacatcggagtacagtataaacaatactggaaaagctgatcagacctactatgtggctggctttagcatactctgtggagcaggcattttcctttgccttgttacatccctcactgtagaatggatgggtctcacagctgccaaaaatcttcaccacaaccttctcaataagataatccttggaccaataaggttttttgataccacacccctgggactgattctcaatcgcttttcagctgatactaatatcattgatcagcacatccctccaaccttggaatctctaactcgctcaacactgctctgcctgtctgccattgggatgatttcttatgctactcctgtgttcctggttgctctcctgccccttggtgttgccttttattttatccagaaatactttcgggttgcctctaaggacctccaggaactcgacgatagtacccagctccctctgctctgtcacttctcagaaacagcagaaggactcaccaccattcgggcctttaggcatgaaaccagatttaaacaacgtatgctggaactgacggatacaaacaacattgcctacttatttctctcagctgccaacagatggctggaggtcaggacggattatctgggagcttgcattgtcctcactgcatctatagcatccattagtgggtcttccaattctggattggtaggcttgggtcttctgtatgcacttacgataaccaattatttgaattgggttgtgaggaacttggctgacctggaggtccagatgggtgcagtgaagaaggtgaacagtttcctgactatggagtcagagaactatgaaggcacaatggatccttctcaagttccagaacattggccacaagaaggggagatcaagatacatgatctgtgtgtcagatatgaaaataatctgaaacctgttcttaagcacgtcaaggcttacatcaaacctggacaaaaggtgggcatatgtggtcgcactggcagtgggaaatcatcgttatctctggctttcttcagaatggttgatatatttgatggaaaaattgtcattgatgggatagacatttccaaattaccactgcacacactacgttctagactttcaatcattctgcaggatccaatactattcagtggttccattagatttaatttagatccagagtgcaaatgcacagatgacagactctgggaagccttagaaattgctcagctgaagaatatggtcaaatctctacctggaggtctagatgcggttgtcactgaaggtggggagaattttagcgtgggacagagacagctattttgccttgccagggcctttgtccgcaaaagcagcattcttattatggatgaggcaacagcttccattgacatggccacagagaatattttgcaaaaagtagtaatgacagcctttgcagaccggaccgtggtgacaatggctcatcgagtacacactattctgacggcagacctggttattgtgatgaagcgaggaaatattttagaatatgacactccagaaagcctcttggctcaggaaaatggagtatttgcttcttttgttcgcgcagacatgtga

SEQ ID NO: 279638 - DNA, 5053 bp, Homo sapiens
ggatggggaaggtctccggccccaggcgcggcgcgcggggcttctgcccagtttcctgcttctcagccgcggtgtctgccccggcccagagcagtctgtgcaatttagaaactcgataggaggcagcagctggtctcccaccaccctaaaaataatccgttccggcgcactgcgtgtttcgcctaggggaggaaaactgtcatcggagagttctgcgtccgggtttgaaatttacatcttaagacagtgtaggaagtcggtgttttgaaggtagctcaagtgcaccggcaggggtttgaagcagcgtgaagctattgcccaaggaaaagtattgtttgtgaccattgctaaatcaattatcaatgaaaggaaagaaagaaaagagtaaaccatataagaagaaatgagcctttcattttgtggtaacaacatttcttcatataatatcaacgatggtgtactacaaaattcctgctttgtggatgccctcaacctggtccctcatgtctttctgttgtttatcacttttccaatattgtttattgggtgggggagccaaagctcaaaagtacaaattcaccacaacacatggcttcattttccgggacataacctgagatggattcttacattcgctctcctgtttgtgcatgtctgtgaaatagcagaaggcattgtttcagactcgcggcgggaatcaaggcacctccacctctttatgccagccgtgatgggattcgttgccactacaacatcgatagtgtattatcataatatcgaaacatcaaattttcctaaattacttttagccctgttcctgtattgggtaatggcctttattacaaaaacaataaaattggttaagtactgtcagtctggcttggacatatcaaacctgcgtttctgcatcacaggcatgatggtcatcttgaatgggctcttgatggctgtggagatcaatgtcattcgagtcaggagatatgtatttttcatgaatcctcagaaagtaaagcctcctgaagacctccaggatctgggagtgagatttcttcaaccatttgtgaatttgctgtcaaaagcaacatactggtggatgaacacacttattatatctgctcacaaaaagcctattgatctgaaggcaattggaaaattgccaatagcaatgagagcagtaacaaattatgtttgcctgaaagatgcatatgaagaacaaaagaaaaaagttgcagatcatccaaatcggactccatctatatggcttgcaatgtacagagcttttgggcgaccaattctacttagtagcacattccgctatctggctgatttactgggttttgctggacctctttgtatttctggaatagttcagcgtgtgaatgaaacccagaatgggacaaataacacaactggaatttcagaaaccctctcatcaaaggaatttcttgaaaacgcttacgttctagcagttcttctcttcttggctcttattctgcaaaggacatttttgcaggcttcctactatgtaaccatagagactggcattaacctccgtggagctctgctggccatgatttataataaaatccttaggctctctacgtctaacttatccatgggggagatgactctggggcagatcaacaacttagtcgccattgaaactaatcaactcatgtggtttttgttcctgtgtcccaatctatgggctatgcctgttcagatcataatgggcgtgattctgctctataatttacttggatcaagtgcattggtcggtgcagctgtcattgtgctccttgcgccaattcagtactttattgctacaaagttggcagaggctcagaaaagtacacttgattattccactgagagactcaagaaaacaaatgaaatattgaaaggcatcaaacttctaaaattgtatgcctgggaacacattttctgcaaaagtgtggaggaaacaagaatgaaagaactatctagtctcaaaacctttgcactatatacatcactctccatcttcatgaatgcagcaattcccatagcagctgttcttgctacatttgtgacccatgcgtatgccagtggaaacaatctgaaacctgcagaggcctttgcttcactgtctctcttccatatcctggtcacaccactgtccctgctcttcacggtggtcagatttgcagtcaaagccatcataagtgttcaaaagctgaatgagtttctcttgagtgatgagattggtgacgacagttggcgaactggtgaaagttcgcttccttttgagtcctgtaagaagcacactggagttcagccaaaaactataaacaggaaacagcctggaagatatcacctggacagctatgagcaatcaacacggcgtctacgtcccgcagaaacagaggacattgcaataaaggtcacaaatggatacttttcatggggcagtggtttagctacattatccaatatagatattcgaattccaacaggtcagttaaccatgattgtgggccaagtaggatgtgggaagtcctctcttctccttgccatcctcggtgagatgcagacattggaaggaaaagttcactggagcaatgtaaatgaatctgagccttcttttgaagcaaccagaagtaggaacaggtactctgtggcatatgcagctcaaaagccttggctattaaatgctacagtagaagaaaatattacttttggaagtccttttaacaaacagaggtacaaagctgtcacagatgcctgttctcttcagccagatattgacttattaccatttggagatcaaactgaaattggagagaggggcatcaacctgagtgggggacagaggcagagaatctgtgtggcacgagcgctgtatcaaaacaccaacattgtctttttggatgatccattctcagccctggacattcacttgagtgatcatttaatgcaggaggggattttgaaattcctgcaagatgacaaaaggacactcgttcttgtgactcacaaattacagtatctgacgcatgctgactggatcatagccatgaaagatggaagtgtcctaagagaaggaactttgaaggacattcaaaccaaagatgttgagctttatgaacactggaaaacacttatgaatcggcaagatcaagaattagaaaaggatatggaagctgaccaaactactttagagaggaaaactctccgacgggccatgtattcaagagaagccaaagcccagatggaggacgaagacgaagaggaagaagaggaggaagatgaggatgataacatgtccactgtaatgaggctcaggactaaaatgccatggaaaacctgctggcgctacctgacatctggaggattcttcctgctcatcctgatgattttctctaagcttttgaagcattcggtcattgtagctatagactattggctggccacatggacatcggagtacagtataaacaatactggaaaagctgatcagacctactatgtggctggctttagcatactctgtggagcaggcattttcctttgccttgttacatccctcactgtagaatggatgggtctcacagctgccaaaaatcttcaccacaaccttctcaataagataatccttggaccaataaggttttttgataccacacccctgggactgattctcaatcgcttttcagctgatactaatatcattgatcagcacatccctccaaccttggaatctctaactcgctcaacactgctctgcctgtctgccattgggatgatttcttatgctactcctgtgttcctggttgctctcctgccccttggtgttgccttttattttatccagaaatactttcgggttgcctctaaggacctccaggaactcgacgatagtacccagctccctctgctctgtcacttctcagaaacagcagaaggactcaccaccattcgggcctttaggcatgaaaccagatttaaacaacgtatgctggaactgacggatacaaacaacattgcctacttatttctctcagctgccaacagatggctggaggtcaggacggattatctgggagcttgcattgtcctcactgcatctatagcatccattagtgggtcttccaattctggattggtaggcttgggtcttctgtatgcacttacgataaccaattatttgaattgggttgtgaggaacttggctgacctggaggtccagatgggtgcagtgaagaaggtgaacagtttcctgactatggagtcagagaactatgaaggcacaatggatccttctcaagttccagaacattggccacaagaaggggagatcaagatacatgatctgtgtgtcagatatgaaaataatctgaaacctgttcttaagcacgtcaaggcttacatcaaacctggacaaaaggtgggcatatgtggtcgcactggcagtgggaaatcatcgttatctctggctttcttcagaatggttgatatatttgatggaaaaattgtcattgatgggatagacatttccaaattaccactgcacacactacgttctagactttcaatcattctgcaggatccaatactattcagtggttccattagatttaatttagatccagagtgcaaatgcacagatgacagactctgggaagccttagaaattgctcagctgaagaatatggtcaaatctctacctggaggtctagatgcggttgtcactgaaggtggggagaattttagcgtgggacagagacagctattttgccttgccagggcctttgtccgcaaaagcagcattcttattatggatgaggcaacagcttccattgacatggccacagagaatattttgcaaaaagtagtaatgacagcctttgcagaccggaccgtggtgacaatggctcaccgtgtctcttctattatggatgcaggccttgttttagtcttttctgagggtattttagtggagtgtgatactgtcccaaatttgttcgcccacaagaatggccccttttccactttggtgatgaccaacaagtag

SEQ ID NO: 279639 - DNA, 638 bp, Homo sapiens
tgtctcccatgaataaggagcccattaagtgttattcatttaatgttcagcaaatattaattgaatgtaggtcttaaatgaaactcctgtgtgtgtgcaaccagtactgctgtctcagaagtgaggctatagttagtgctgttttgggggccacctttccttctgggcctttgtactgagcgtttagagcgtagatatgttcacccactgagagcggatggtgaatgcctgttcctttagtctttttgtgatgattttgctttttatagggaggacagagtctccgcctgggcaccttctcttaagaactggctttgcacacagccgatgcagtccctgggcactttgaaagcagtgggcaaaagggcaggttacactaaagcaagtcccagatgtcacatcatttcaatgaggagggtatggtgagatgcagctcttcccctccctccagcagggcaaaagaggaggaaaggagaatggagtcacaatgagggagattttggaggccggaagatctagatgtgaggtcctctctgtcagtttctggaagtgtgactgacctagggtccccacataccgaaccaaccagcatctgcagcaccatctcgccaactcctgcccctgtcaccagcactgtg

SEQ ID NO: 279640 - DNA, 741 bp, Homo sapiens
cttacctgcatccttacccgcattctcacctgcctccaccccactgcaagtgaagagcagcaggtagcacaagaaaagcgataccgccttctgccgcatggtggcgccgcgcgcgggctccgtcactagacctgcgaacgggcgagagggagatggtccccggagcatttttggagctcatcagctccgttgttttcccttccagttccaactgaatcagtaaaaagcagcgaggtgtggtgaatggaacccaggatccctctcaggagcctcgggaatccgtttcctctccgcatcagtggcagagatgtccctgccccaaccggtgggtgtgcggattctgtgcggattcgcacggtgtttggcacgtgaaagaaagcacagaagggtgtgtggaaaaagaaactcagtttccctcaccgtacgagaggcttctgacagcagaagtgtgggggtttctccccaccagcaagcaaacaatcagtcctctggtgaacaccagctgagggtccccaaattcaattctgacaccactatgggtagatagtggccgatcccacatgttgagggttcagtcccccagactgccaatcgaaagccctaggttgttttacctgtgtttctgactgactataaactggggttcccacaattccctcctgcagttttactaatttgctagagcagctcacagaactcagggaaacactttacttacatatactggtttctttctttaaa

SEQ ID NO: 279641 - DNA, 2366 bp, Homo sapiens
cccgggaatcgcacaggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggccggcgcggggcgaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccgcccgcctgccaggagacaatgctttggacatgttccagaagcatcgagagaaggaactgaaagacagacagcagatctactgctgggccacctggaaggaagggttacccctgaccatcgctgcagaccgtaaggatgatctacctccaaatatgagattccatgaggagaagaggctggactttgaatggacactgaaggcaggggctctggagatggccctcaaacgtgtttacaccctcctgagctcctggaactgcctagaagactttgatcagatcttctggggccagaagagtgccctggctgagaaggttcgccagtgctggcaggatgatgagttgttcagctaccagttcctcaatggtgccaaccccatgctgttgagacgctcgacctctctgccctccaggctagtgctgccctcggggatggaagagcttcaggctcaactggagaaagaacttcagaatggttccctgtttgaagctgacttcatccttctggatggaattccagccaacgtgatccgaggagagaagcaatacctggctgcccccctcgttatgctgaagatggagcccaatgggaagctgcagcccatggtcatccagattcagcctcccaaccccagctctccaaccccaacactgttcctgccctcagaccccccacttgcctggctcctggcaaagtcctgggtccgaaattcagatttccaactgcacgagatccagtatcacttgctgaacacgcacctggtggctgaggtcatcgctgtcgccaccatgcggtgcctcccaggactgcaccccatcttcaagttcctgatcccccatatccgctacaccatggaaatcaacacccgggcccggacccaactcatctcagatggaggaatttttgataaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtatgtggaggggatcgtccacctcttctaccaaagggatgacatagtgaagggggaccctgagctgcaggcctggtgtcgggagatcacggaggtggggctgtgccaggcccaggaccgaggtttccctgtctccttccagtcccagagtcaactctgccatttcctcaccatgtgcgtcttcacgtgcactgcccagcatgccgccatcaaccagggccagctggactggtatgcctgggtccctaatgctccatgcacaatgcggatgcccccacccaccaccaaggaagatgtgacgatggccacagtgatggggtcactacctgatgtccggcaggcctgtcttcaaatggccatctcatggcatctgagtcgccgccagccagacatggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactgagatatgaa

SEQ ID NO: 279642 - DNA, 1031 bp, Homo sapiens
tgatacatcatctcatttataatgtaggtatcgtccatattttacaggtgaaaaaaactgaggttcaaataggttaagctggcctatggtaactaagtgtaagtgactgagccaggacttaaacgcatgtctgatgcaaatacgtctaaataaaataaacaaattcatcaattctaaaatatgggcatcccaaaacaacagcctttgttcctctcctcttatgctgtagcttctaactgctattcctttcctgcccaggtttccctgtctccttccagtcccagagtcaactctgccatttcctcaccatgtgcgtcttcacgtgcactgcccagcatgccgccatcaaccagggccagctggactggtatgcctgggtccctaatgctccatgcacaatgcggatgcccccacccaccaccaaggaagatgtgacgatggccacagtgatggggtcactacctgatgtccggcaggcctgtcttcaaatggccatctcatggcatctgagtcgccgccagccagacatggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactgagatatgaa

SEQ ID NO: 279643 - DNA, 356 bp, Homo sapiens
gacccaaagagcaggttgtgcgggggcgggaacgaggcgatgctgtctttggaggccctgagaaactgaggttgcacaggagcgcggctctgtcctcgaaacggcctcagtcgggtccctcctactaagtctggcctgggtccggcctgcacaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccg

SEQ ID NO: 279644 - DNA, 1951 bp, Homo sapiens
agctctagcaggatctcctgcggagagagaactgaaagacagacagcagatctactgctgggccacctggaaggaagggttacccctgaccatcgctgcagaccgtaaggatgatctacctccaaatatgagattccatgaggagaagaggctggactttgaatggacactgaaggcaggggctctggagatggccctcaaacgtgtttacaccctcctgagctcctggaactgcctagaagactttgatcagatcttctggggccagaagagtgccctggctgagaaggttcgccagtgctggcaggatgatgagttgttcagctaccagttcctcaatggtgccaaccccatgctgttgagacgctcgacctctctgccctccaggctagtgctgccctcggggatggaagagcttcaggctcaactggagaaagaacttcagaatggttccctgtttgaagctgacttcatccttctggatggaattccagccaacgtgatccgaggagagaagcaatacctggctgcccccctcgttatgctgaagatggagcccaatgggaagctgcagcccatggtcatccagattcagcctcccaaccccagctctccaaccccaacactgttcctgccctcagaccccccacttgcctggctcctggcaaagtcctgggtccgaaattcagatttccaactgcacgagatccagtatcacttgctgaacacgcacctggtggctgaggtcatcgctgtcgccaccatgcggtgcctcccaggactgcaccccatcttcaagttcctgatcccccatatccgctacaccatggaaatcaacacccgggcccggacccaactcatctcagatggaggaatttttgataaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtatgtggaggggatcgtccacctcttctaccaaagggatgacatagtgaagggggaccctgagctgcaggcctggtgtcgggagatcacggaggtggggctgtgccaggcccaggaccgaggtttccctgtctccttccagtcccagagtcaactctgccatttcctcaccatgtgcgtcttcacgtgcactgcccagcatgccgccatcaaccagggccagctggactggtatgcctgggtccctaatgctccatgcacaatgcggatgcccccacccaccaccaaggaagatgtgacgatggccacagtgatggggtcactacctgatgtccggcaggcctgtcttcaaatggccatctcatggcatctgagtcgccgccagccagacatggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactgagatatgaa

SEQ ID NO: 279645 - DNA, 1010 bp, Homo sapiens
cggacgcgtgggtcgacccacgcgtcgcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaagctggttgtctttatttacaagatatcaaaaatataaaaactgtacaaaatgcaacaaaggcaaaaactggcagtgacttggtctaaatcttttagtttcccaaagcaaggctcagtactggaggtaagcaactgaaatgtctgtctgacttcaagtgtactaggttgtatgtagctgttttagctgaagtagaacatggaagctaaatttcttcacctggtttatcgagtgtttgggtgcactcaaaactcaacaggtatataaattcagatgtcagtgggtggctgtacttcctctagatctaagaaaggaaccctacctagttacatacattccattaatcatgggccaagaaaaaaaaagttagtggatcatttaacatagtttttgagtgccatacagtaactacgtttttacagcagaaacatacatgctcataggattcttcagctaaaattcaagatgatagtatatttctgaatttgaatcttgaagcaggatgaattattgaaatcaactttttttctaaatgtaataaattaaaatagcatttgaacagaaaatgcatagtttccacacaatccaaagcaccataaatgtcccctccatgatcataatacctcttattcaactaac

SEQ ID NO: 279646 - DNA, 634 bp, Homo sapiens
atccccatcaccggccgaattaacctcttttcttctgtatgtccacagctgtttgttcccaccgagctgtgctttaggaagctggccagccgggcctcctttaggtgcgctgcagcctttttcaaagcgagtgaatgtggcccggcccctacagttcgccaggcccgctgtaaaagggttagatttcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacc

SEQ ID NO: 279647 - DNA, 630 bp, Homo sapiens
  misc_feature (19)..(19): n is a, c, g, or t
gcggacaatgatggtacantcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaaccaaaaacaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaacgaggggggggggggcaggcagggagagagaggcgcacagccgacaggggggcaggagacacagagaaagaaagaagaaggaggagaagggaggaggagaagaagggatgaaagagggcgaggcaggcaccaagaagaagcagcgggggagagaggaagggaaagaaagt

SEQ ID NO: 279648 - DNA, 413 bp, Homo sapiens
cgggggaggtggcttcttccggcgggcgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacccggaagaagaaaatatccgggtacgagctca

SEQ ID NO: 279649 - DNA, 881 bp, Homo sapiens
gaatatcgaataagggtgttattgtccatatatagacccaggccccaaaaaaaaagaagtttttttgcccctcaacattaagagataaactggttctaaaaaatttcacccggtcggacagttgaactaccaccaactcaaactaggtccaatttggtgatgagcgacgggggcccccccccccccccacttttataaaatttttttttttttctttttttttttttttgatgaacctggaaaagctggttgtctttatttacaagatatcaaaaatataaaaactgtacaaaatgcaacaaaggcaaaaactggcagtgacttggtctaaatcttttagtttcccaaagcaaggctcagtactggaggtaagcaactgaaatgtctgtctgacttcaagtgtactaggttgtatgtagctgttttagctgaagtagaacatggaagctaaatttcttcacctggtttatcgagtgtttgggtgcactcaaaactcaacaggtatataaattcagatgtcagtgggtggctgtacttcctctagatctaagaaaggaaccctacctagttacatacattccattaatcatgggccaagaaaaaaaaagttagtggatcatttaacatagtttttgagtgccatacagtaactacgtttttacagcagaaacatacatgctcataggattcttcagctaaaattcaagatgatagtatatttctgaatttgaatcttgaagcaggatgaattattgaaatcaactttttttctaaatgtaataaattaaaatagcatttgaacagaaaatgcatagtttccacacaatccaaagcaccataaatgtcccctccatgatcataatacctcttattcaactaac

SEQ ID NO: 279650 - DNA, 321 bp, Homo sapiens
gcgactactactactaaattcgcagcggttcgacgcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacc

SEQ ID NO: 279651 - DNA, 413 bp, Homo sapiens
cgggggaggtggcttcttccggcgggcgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaaccggcagaagcatatttacggcgtaccgaccgt

SEQ ID NO: 279652 - DNA, 365 bp, Homo sapiens
gcgtcgacataccagtgaactggtattgcgcatcactttctggacctgccatgatttcaatctgccaaagccgcaaattccgcagctggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctgggagagaaaggaaggaggaaaagtc

SEQ ID NO: 279653 - DNA, 463 bp, Homo sapiens
  misc_feature (64)..(64): n is a, c, g, or t
  misc_feature (67)..(67): n is a, c, g, or t
  misc_feature (94)..(95): n is a, c, g, or t
  misc_feature (100)..(100): n is a, c, g, or t
  misc_feature (176)..(176): n is a, c, g, or t
  misc_feature (249)..(249): n is a, c, g, or t
  misc_feature (263)..(263): n is a, c, g, or t
  misc_feature (291)..(291): n is a, c, g, or t
  misc_feature (307)..(307): n is a, c, g, or t
  misc_feature (309)..(309): n is a, c, g, or t
  misc_feature (313)..(313): n is a, c, g, or t
  misc_feature (315)..(315): n is a, c, g, or t
  misc_feature (318)..(318): n is a, c, g, or t
  misc_feature (325)..(325): n is a, c, g, or t
  misc_feature (397)..(397): n is a, c, g, or t
gcgaattcggccattatggccggggggctttttttcgccggtccgagaggtggctacattcgtnganggacacagctgcggaattgcggcttgnnagatngaaatcatggcaggtccagaaagtgatgcgcaataccagttcactggtattaaaaaatatttcaactcttatactntcacaggtagaatgaactgtgtactggccacatatggaagcattgcattgattgtcttatatttcaagttaangtccaaaaaaactncagctgtgaaagcaacataatggatttnaaactgtctacggttntnaacntnatntgtaagntcccatgcctgaggaagtaatggccactccggatgtgtaaattaaatttgacaataaatattgacctcggtnaaaacaaaaaaacccaccttttctttatagcttcttttcggccctccatgtgccttccccctcccc

SEQ ID NO: 279654 - DNA, 1035 bp, Homo sapiens
  misc_feature (64)..(64): n is a, c, g, or t
  misc_feature (67)..(67): n is a, c, g, or t
  misc_feature (94)..(95): n is a, c, g, or t
  misc_feature (100)..(100): n is a, c, g, or t
  misc_feature (176)..(176): n is a, c, g, or t
  misc_feature (249)..(249): n is a, c, g, or t
  misc_feature (263)..(263): n is a, c, g, or t
  misc_feature (291)..(291): n is a, c, g, or t
  misc_feature (307)..(307): n is a, c, g, or t
  misc_feature (309)..(309): n is a, c, g, or t
  misc_feature (313)..(313): n is a, c, g, or t
  misc_feature (315)..(315): n is a, c, g, or t
  misc_feature (318)..(318): n is a, c, g, or t
  misc_feature (325)..(325): n is a, c, g, or t
  misc_feature (342)..(342): n is a, c, g, or t
  misc_feature (344)..(347): n is a, c, g, or t
  misc_feature (349)..(351): n is a, c, g, or t
  misc_feature (355)..(355): n is a, c, g, or t
gcgaattcggccattatggccggggggctttttttcgccggtccgagaggtggctacattcgtnganggacacagctgcggaattgcggcttgnnagatngaaatcatggcaggtccagaaagtgatgcgcaataccagttcactggtattaaaaaatatttcaactcttatactntcacaggtagaatgaactgtgtactggccacatatggaagcattgcattgattgtcttatatttcaagttaangtccaaaaaaactncagctgtgaaagcaacataatggatttnaaactgtctacggttntnaacntnatntgtaagntcccatgcccggaagangnnnntnnnccgnatcattttcttcttccggccgggccgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacccggaagaagaaaaaaaaaaaaaaaaaaaaaaaaacaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaacgaggggggggggggcaggcagggagagagaggcgcacagccgacaggggggcaggagacacagagaaagaaagaagaaggaggagaagggaggaggagaagaagggatgaaagagggcgaggcaggcaccaagaagaagcagcgggggagagaggaagggaaagaaagt

SEQ ID NO: 279655 - DNA, 735 bp, Homo sapiens
  misc_feature (64)..(64): n is a, c, g, or t
  misc_feature (67)..(67): n is a, c, g, or t
  misc_feature (94)..(95): n is a, c, g, or t
  misc_feature (100)..(100): n is a, c, g, or t
  misc_feature (176)..(176): n is a, c, g, or t
  misc_feature (249)..(249): n is a, c, g, or t
  misc_feature (263)..(263): n is a, c, g, or t
  misc_feature (291)..(291): n is a, c, g, or t
  misc_feature (307)..(307): n is a, c, g, or t
  misc_feature (309)..(309): n is a, c, g, or t
  misc_feature (313)..(313): n is a, c, g, or t
  misc_feature (315)..(315): n is a, c, g, or t
  misc_feature (318)..(318): n is a, c, g, or t
  misc_feature (325)..(325): n is a, c, g, or t
  misc_feature (342)..(342): n is a, c, g, or t
  misc_feature (344)..(347): n is a, c, g, or t
  misc_feature (349)..(351): n is a, c, g, or t
  misc_feature (355)..(355): n is a, c, g, or t
gcgaattcggccattatggccggggggctttttttcgccggtccgagaggtggctacattcgtnganggacacagctgcggaattgcggcttgnnagatngaaatcatggcaggtccagaaagtgatgcgcaataccagttcactggtattaaaaaatatttcaactcttatactntcacaggtagaatgaactgtgtactggccacatatggaagcattgcattgattgtcttatatttcaagttaangtccaaaaaaactncagctgtgaaagcaacataatggatttnaaactgtctacggttntnaacntnatntgtaagntcccatgcccggaagangnnnntnnnccgnatcattttcttcttccggccgggccgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacc

SEQ ID NO: 279656 - DNA, 1493 bp, Homo sapiens
cggacgcgtgggtcgacccacgcgtcgcgttgaaggacaccagctgcggaatttgcggctttggcagctgtttgttcccaccgagctgtgctttaggaagctggccagccgggcctcctttaggtgcgctgcagcctttttcaaagcgagtgaatgtggcccggcccctacagttcgccaggcccgctgtaaaagggttagatttcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagacccagctgagtcactgtcactgcctaccaatctcgaccggacctcgaccggctcgtctgtgctgccaatcgactcggcgtggcgtcggtcgtggtagataggcggtcatgcatacgaattttcagctcttgttctggtgaccttttgaatacgtcttgtctataaaagaaattcatgcctttgtaaaatacacagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaagctggttgtctttatttacaagatatcaaaaatataaaaactgtacaaaatgcaacaaaggcaaaaactggcagtgacttggtctaaatcttttagtttcccaaagcaaggctcagtactggaggtaagcaactgaaatgtctgtctgacttcaagtgtactaggttgtatgtagctgttttagctgaagtagaacatggaagctaaatttcttcacctggtttatcgagtgtttgggtgcactcaaaactcaacaggtatataaattcagatgtcagtgggtggctgtacttcctctagatctaagaaaggaaccctacctagttacatacattccattaatcatgggccaagaaaaaaaaagttagtggatcatttaacatagtttttgagtgccatacagtaactacgtttttacagcagaaacatacatgctcataggattcttcagctaaaattcaagatgatagtatatttctgaatttgaatcttgaagcaggatgaattattgaaatcaactttttttctaaatgtaataaattaaaatagcatttgaacagaaaatgcatagtttccacacaatccaaagcaccataaatgtcccctccatgatcataatacctcttattcaactaac

SEQ ID NO: 279657 - DNA, 684 bp, Homo sapiens
cggacgcgtgggtcgacccacgcgtcgcgttgaaggacaccagctgcggaatttgcggctttggcagctgtttgttcccaccgagctgtgctttaggaagctggccagccgggcctcctttaggtgcgctgcagcctttttcaaagcgagtgaatgtggcccggcccctacagttcgccaggcccgctgtaaaagggttagatttcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaacaacaaagacagcacactgaagacag

SEQ ID NO: 279658 - DNA, 1026 bp, Homo sapiens
cgggggaggtggcttcttccggcgggcgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaagctggttgtctttatttacaagatatcaaaaatataaaaactgtacaaaatgcaacaaaggcaaaaactggcagtgacttggtctaaatcttttagtttcccaaagcaaggctcagtactggaggtaagcaactgaaatgtctgtctgacttcaagtgtactaggttgtatgtagctgttttagctgaagtagaacatggaagctaaatttcttcacctggtttatcgagtgtttgggtgcactcaaaactcaacaggtatataaattcagatgtcagtgggtggctgtacttcctctagatctaagaaaggaaccctacctagttacatacattccattaatcatgggccaagaaaaaaaaagttagtggatcatttaacatagtttttgagtgccatacagtaactacgtttttacagcagaaacatacatgctcataggattcttcagctaaaattcaagatgatagtatatttctgaatttgaatcttgaagcaggatgaattattgaaatcaactttttttctaaatgtaataaattaaaatagcatttgaacagaaaatgcatagtttccacacaatccaaagcaccataaatgtcccctccatgatcataatacctcttattcaactaac

SEQ ID NO: 279659 - DNA, 617 bp, Homo sapiens
  misc_feature (522)..(522): n is a, c, g, or t
  misc_feature (555)..(555): n is a, c, g, or t
  misc_feature (617)..(617): n is a, c, g, or t
gcggccgcctactactactactaaattcgcggccgcgtccgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacccggaagaagaaaaaaaaaaaaaaaaaaaacccgttttatgatttactcattatcgccttttgacagctgtgcttgaacacaagtagatgcctgaacttgaattaatccacacatcagtaatggattctatctctctttacattntggtctctatactacattattaatgggttctgngtactgtaaagaatttagctgatcctagggcatgaatggattctctcctgaatatttcactn

SEQ ID NO: 279660 - DNA, 1007 bp, Homo sapiens
  misc_feature (64)..(64): n is a, c, g, or t
  misc_feature (67)..(67): n is a, c, g, or t
  misc_feature (94)..(95): n is a, c, g, or t
  misc_feature (100)..(100): n is a, c, g, or t
  misc_feature (176)..(176): n is a, c, g, or t
  misc_feature (249)..(249): n is a, c, g, or t
  misc_feature (263)..(263): n is a, c, g, or t
  misc_feature (291)..(291): n is a, c, g, or t
  misc_feature (307)..(307): n is a, c, g, or t
  misc_feature (309)..(309): n is a, c, g, or t
  misc_feature (313)..(313): n is a, c, g, or t
  misc_feature (315)..(315): n is a, c, g, or t
  misc_feature (318)..(318): n is a, c, g, or t
  misc_feature (325)..(325): n is a, c, g, or t
  misc_feature (342)..(342): n is a, c, g, or t
  misc_feature (344)..(347): n is a, c, g, or t
  misc_feature (349)..(351): n is a, c, g, or t
  misc_feature (355)..(355): n is a, c, g, or t
  misc_feature (765)..(766): n is a, c, g, or t
  misc_feature (770)..(770): n is a, c, g, or t
  misc_feature (779)..(779): n is a, c, g, or t
  misc_feature (787)..(787): n is a, c, g, or t
  misc_feature (790)..(790): n is a, c, g, or t
gcgaattcggccattatggccggggggctttttttcgccggtccgagaggtggctacattcgtnganggacacagctgcggaattgcggcttgnnagatngaaatcatggcaggtccagaaagtgatgcgcaataccagttcactggtattaaaaaatatttcaactcttatactntcacaggtagaatgaactgtgtactggccacatatggaagcattgcattgattgtcttatatttcaagttaangtccaaaaaaactncagctgtgaaagcaacataatggatttnaaactgtctacggttntnaacntnatntgtaagntcccatgcccggaagangnnnntnnnccgnatcattttcttcttccggccgggccgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctaaaaaaaaaaaaaaaaaaaaaaaaaaaanntttntggggggcntgggcccnggnaaaagttttttaaaacaatgtggtggggggggggggcccccgtaggtgttagttgaacggtggccaagaggggtgccaaggaaaaccgggcaggacaaaggggtgggattcctcaccaaaataaaaaaggccggggggaaccgaggcgtctggacaatccaaagggagtccggaggcacaacgggctctacacgggggtcaagggagcggatataat

SEQ ID NO: 279661 - DNA, 1006 bp, Homo sapiens
  misc_feature (64)..(64): n is a, c, g, or t
  misc_feature (67)..(67): n is a, c, g, or t
  misc_feature (94)..(95): n is a, c, g, or t
  misc_feature (100)..(100): n is a, c, g, or t
  misc_feature (176)..(176): n is a, c, g, or t
  misc_feature (249)..(249): n is a, c, g, or t
  misc_feature (263)..(263): n is a, c, g, or t
  misc_feature (291)..(291): n is a, c, g, or t
  misc_feature (307)..(307): n is a, c, g, or t
  misc_feature (309)..(309): n is a, c, g, or t
  misc_feature (313)..(313): n is a, c, g, or t
  misc_feature (315)..(315): n is a, c, g, or t
  misc_feature (318)..(318): n is a, c, g, or t
  misc_feature (325)..(325): n is a, c, g, or t
  misc_feature (342)..(342): n is a, c, g, or t
  misc_feature (344)..(347): n is a, c, g, or t
  misc_feature (349)..(351): n is a, c, g, or t
  misc_feature (355)..(355): n is a, c, g, or t
gcgaattcggccattatggccggggggctttttttcgccggtccgagaggtggctacattcgtnganggacacagctgcggaattgcggcttgnnagatngaaatcatggcaggtccagaaagtgatgcgcaataccagttcactggtattaaaaaatatttcaactcttatactntcacaggtagaatgaactgtgtactggccacatatggaagcattgcattgattgtcttatatttcaagttaangtccaaaaaaactncagctgtgaaagcaacataatggatttnaaactgtctacggttntnaacntnatntgtaagntcccatgcccggaagangnnnntnnnccgnatcattttcttcttccggccgggccgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaaccaaaaacaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaacgaggggggggggggcaggcagggagagagaggcgcacagccgacaggggggcaggagacacagagaaagaaagaagaaggaggagaagggaggaggagaagaagggatgaaagagggcgaggcaggcaccaagaagaagcagcgggggagagaggaagggaaagaaagt

SEQ ID NO: 279662 - DNA, 653 bp, Homo sapiens
cggacgcgtgggtcgacccacgcgtcgcgttgaaggacaccagctgcggaatttgcggctttggcagctgtttgttcccaccgagctgtgctttaggaagctggccagccgggcctcctttaggtgcgctgcagcctttttcaaagcgagtgaatgtggcccggcccctacagttcgccaggcccgctgtaaaagggttagatttcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacc

SEQ ID NO: 279663 - DNA, 641 bp, Homo sapiens
cggacgcgtgggtcgacccacgcgtcgcgttgaaggacaccagctgcggaatttgcggctttggcagctgtttgttcccaccgagctgtgctttaggaagctggccagccgggcctcctttaggtgcgctgcagcctttttcaaagcgagtgaatgtggcccggcccctacagttcgccaggcccgctgtaaaagggttagatttcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctgggttaggtctacctgggttaggtctacctgggttaggtctacctgg

SEQ ID NO: 279664 - DNA, 1491 bp, Homo sapiens
cggacgcgtgggtcgacccacgcgtcgcgttgaaggacaccagctgcggaatttgcggctttggcagacccagctgagtcactgtcactgcctaccaatctcgaccggacctcgaccggctcgtctgtgctgccaatcgactcggcgtggcgtcggtcgtggtagataggcggtcatgcatacgaattttcagctcttgttctggtgaccttttgaatacgtcttgtctataaaagaaattcatgcctttgtaaaatacacagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggtttattttcttataatcctccaacccccatttgcccaccctttaaatatctgttgtgttggcaatgggtgatatgtggaaagcctgggcaacaagagcgaactctgtctcaaaaaaaaaaaagtattaatctgagatacactttaatttttttggtgttacatctttgacaatctaataaattcgcattcagtttcagtgggttcatgttaccttagtaattcttgagtgtcttaagagtaaagctggccacatttgtatctaaactgtttgctttgtttataggattttaaactgtctacggttcttaacctcatctgttaagttcccatgcctggagaagctaatgccaactcatcatgtgataattcaatttgtacaataaattatgaacctggaaaagctggttgtctttatttacaagatatcaaaaatataaaaactgtacaaaatgcaacaaaggcaaaaactggcagtgacttggtctaaatcttttagtttcccaaagcaaggctcagtactggaggtaagcaactgaaatgtctgtctgacttcaagtgtactaggttgtatgtagctgttttagctgaagtagaacatggaagctaaatttcttcacctggtttatcgagtgtttgggtgcactcaaaactcaacaggtatataaattcagatgtcagtgggtggctgtacttcctctagatctaagaaaggaaccctacctagttacatacattccattaatcatgggccaagaaaaaaaaagttagtggatcatttaacatagtttttgagtgccatacagtaactacgtttttacagcagaaacatacatgctcataggattcttcagctaaaattcaagatgatagtatatttctgaatttgaatcttgaagcaggatgaattattgaaatcaactttttttctaaatgtaataaattaaaatagcatttgaacagaaaatgcatagtttccacacaatccaaagcaccataaatgtcccctccatgatcataatacctcttattcaactaac

SEQ ID NO: 279665 - DNA, 228 bp, Homo sapiens
atatcagttgcaaatatttctttttctagtttgtttccaatgtttatgtaattctgtcttttccttaaatccccataggttttattttcttataatcctccaacccccatttgcccaccctttaaatatctgttgtgttggcaatgggtgatatgtggaaagcccaaatgccagatcttcatctgatgtagctctccttcgcagacttttttttttttgagatggagt

SEQ ID NO: 279666 - DNA, 1379 bp, Homo sapiens
  misc_feature (64)..(64): n is a, c, g, or t
  misc_feature (67)..(67): n is a, c, g, or t
  misc_feature (94)..(95): n is a, c, g, or t
  misc_feature (100)..(100): n is a, c, g, or t
  misc_feature (176)..(176): n is a, c, g, or t
  misc_feature (249)..(249): n is a, c, g, or t
  misc_feature (263)..(263): n is a, c, g, or t
  misc_feature (291)..(291): n is a, c, g, or t
  misc_feature (307)..(307): n is a, c, g, or t
  misc_feature (309)..(309): n is a, c, g, or t
  misc_feature (313)..(313): n is a, c, g, or t
  misc_feature (315)..(315): n is a, c, g, or t
  misc_feature (318)..(318): n is a, c, g, or t
  misc_feature (325)..(325): n is a, c, g, or t
  misc_feature (342)..(342): n is a, c, g, or t
  misc_feature (344)..(347): n is a, c, g, or t
  misc_feature (349)..(351): n is a, c, g, or t
  misc_feature (355)..(355): n is a, c, g, or t
gcgaattcggccattatggccggggggctttttttcgccggtccgagaggtggctacattcgtnganggacacagctgcggaattgcggcttgnnagatngaaatcatggcaggtccagaaagtgatgcgcaataccagttcactggtattaaaaaatatttcaactcttatactntcacaggtagaatgaactgtgtactggccacatatggaagcattgcattgattgtcttatatttcaagttaangtccaaaaaaactncagctgtgaaagcaacataatggatttnaaactgtctacggttntnaacntnatntgtaagntcccatgcccggaagangnnnntnnnccgnatcattttcttcttccggccgggccgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaagctggttgtctttatttacaagatatcaaaaatataaaaactgtacaaaatgcaacaaaggcaaaaactggcagtgacttggtctaaatcttttagtttcccaaagcaaggctcagtactggaggtaagcaactgaaatgtctgtctgacttcaagtgtactaggttgtatgtagctgttttagctgaagtagaacatggaagctaaatttcttcacctggtttatcgagtgtttgggtgcactcaaaactcaacaggtatataaattcagatgtcagtgggtggctgtacttcctctagatctaagaaaggaaccctacctagttacatacattccattaatcatgggccaagaaaaaaaaagttagtggatcatttaacatagtttttgagtgccatacagtaactacgtttttacagcagaaacatacatgctcataggattcttcagctaaaattcaagatgatagtatatttctgaatttgaatcttgaagcaggatgaattattgaaatcaactttttttctaaatgtaataaattaaaatagcatttgaacagaaaatgcatagtttccacacaatccaaagcaccataaatgtcccctccatgatcataatacctcttattcaactaac

SEQ ID NO: 279667 - DNA, 974 bp, Homo sapiens
  misc_feature (64)..(64): n is a, c, g, or t
  misc_feature (67)..(67): n is a, c, g, or t
  misc_feature (94)..(95): n is a, c, g, or t
  misc_feature (100)..(100): n is a, c, g, or t
  misc_feature (176)..(176): n is a, c, g, or t
  misc_feature (249)..(249): n is a, c, g, or t
  misc_feature (263)..(263): n is a, c, g, or t
  misc_feature (291)..(291): n is a, c, g, or t
  misc_feature (307)..(307): n is a, c, g, or t
  misc_feature (309)..(309): n is a, c, g, or t
  misc_feature (313)..(313): n is a, c, g, or t
  misc_feature (315)..(315): n is a, c, g, or t
  misc_feature (318)..(318): n is a, c, g, or t
  misc_feature (325)..(325): n is a, c, g, or t
  misc_feature (342)..(342): n is a, c, g, or t
  misc_feature (344)..(347): n is a, c, g, or t
  misc_feature (349)..(351): n is a, c, g, or t
  misc_feature (355)..(355): n is a, c, g, or t
  misc_feature (879)..(879): n is a, c, g, or t
  misc_feature (912)..(912): n is a, c, g, or t
  misc_feature (974)..(974): n is a, c, g, or t
gcgaattcggccattatggccggggggctttttttcgccggtccgagaggtggctacattcgtnganggacacagctgcggaattgcggcttgnnagatngaaatcatggcaggtccagaaagtgatgcgcaataccagttcactggtattaaaaaatatttcaactcttatactntcacaggtagaatgaactgtgtactggccacatatggaagcattgcattgattgtcttatatttcaagttaangtccaaaaaaactncagctgtgaaagcaacataatggatttnaaactgtctacggttntnaacntnatntgtaagntcccatgcccggaagangnnnntnnnccgnatcattttcttcttccggccgggccgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacccggaagaagaaaaaaaaaaaaaaaaaaaacccgttttatgatttactcattatcgccttttgacagctgtgcttgaacacaagtagatgcctgaacttgaattaatccacacatcagtaatggattctatctctctttacattntggtctctatactacattattaatgggttctgngtactgtaaagaatttagctgatcctagggcatgaatggattctctcctgaatatttcactn

SEQ ID NO: 279668 - DNA, 1297 bp, Homo sapiens
cggacgcgtgggtcgacccacgcgtcgcgttgaaggacaccagctgcggaatttgcggctttggcagctgtttgttcccaccgagctgtgctttaggaagctggccagccgggcctcctttaggtgcgctgcagcctttttcaaagcgagtgaatgtggcccggcccctacagttcgccaggcccgctgtaaaagggttagatttcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaagctggttgtctttatttacaagatatcaaaaatataaaaactgtacaaaatgcaacaaaggcaaaaactggcagtgacttggtctaaatcttttagtttcccaaagcaaggctcagtactggaggtaagcaactgaaatgtctgtctgacttcaagtgtactaggttgtatgtagctgttttagctgaagtagaacatggaagctaaatttcttcacctggtttatcgagtgtttgggtgcactcaaaactcaacaggtatataaattcagatgtcagtgggtggctgtacttcctctagatctaagaaaggaaccctacctagttacatacattccattaatcatgggccaagaaaaaaaaagttagtggatcatttaacatagtttttgagtgccatacagtaactacgtttttacagcagaaacatacatgctcataggattcttcagctaaaattcaagatgatagtatatttctgaatttgaatcttgaagcaggatgaattattgaaatcaactttttttctaaatgtaataaattaaaatagcatttgaacagaaaatgcatagtttccacacaatccaaagcaccataaatgtcccctccatgatcataatacctcttattcaactaac

SEQ ID NO: 279669 - DNA, 849 bp, Homo sapiens
cggacgcgtgggtcgacccacgcgtcgcgttgaaggacaccagctgcggaatttgcggctttggcagctgtttgttcccaccgagctgtgctttaggaagctggccagccgggcctcctttaggtgcgctgcagcctttttcaaagcgagtgaatgtggcccggcccctacagttcgccaggcccgctgtaaaagggttagatttcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagacccagctgagtcactgtcactgcctaccaatctcgaccggacctcgaccggctcgtctgtgctgccaatcgactcggcgtggcgtcggtcgtggtagataggcggtcatgcatacgaattttcagctcttgttctggtgaccttttgaatacgtcttgtctataaaagaaattcatgcctttgtaaaatacacagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacc

SEQ ID NO: 279670 - DNA, 1042 bp, Homo sapiens
  misc_feature (64)..(64): n is a, c, g, or t
  misc_feature (67)..(67): n is a, c, g, or t
  misc_feature (94)..(95): n is a, c, g, or t
  misc_feature (100)..(100): n is a, c, g, or t
  misc_feature (176)..(176): n is a, c, g, or t
  misc_feature (249)..(249): n is a, c, g, or t
  misc_feature (263)..(263): n is a, c, g, or t
  misc_feature (291)..(291): n is a, c, g, or t
  misc_feature (307)..(307): n is a, c, g, or t
  misc_feature (309)..(309): n is a, c, g, or t
  misc_feature (313)..(313): n is a, c, g, or t
  misc_feature (315)..(315): n is a, c, g, or t
  misc_feature (318)..(318): n is a, c, g, or t
  misc_feature (325)..(325): n is a, c, g, or t
  misc_feature (342)..(342): n is a, c, g, or t
  misc_feature (344)..(347): n is a, c, g, or t
  misc_feature (349)..(351): n is a, c, g, or t
  misc_feature (355)..(355): n is a, c, g, or t
gcgaattcggccattatggccggggggctttttttcgccggtccgagaggtggctacattcgtnganggacacagctgcggaattgcggcttgnnagatngaaatcatggcaggtccagaaagtgatgcgcaataccagttcactggtattaaaaaatatttcaactcttatactntcacaggtagaatgaactgtgtactggccacatatggaagcattgcattgattgtcttatatttcaagttaangtccaaaaaaactncagctgtgaaagcaacataatggatttnaaactgtctacggttntnaacntnatntgtaagntcccatgcccggaagangnnnntnnnccgnatcattttcttcttccggccgggccgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaacccctccttcctttcccttccttctctcatccttcttatctcttcctcactcctctctttcttcctttcttcttctcttctcttctcccttctctctccctttctctcctctctctcctcctctcgtccaccccatttcatccctgctcacctcttgtctctctccctttgtctcctttctatcatcacctctacctcttctccctctcactccactctcgtcccctcttctctaccctccttctctctacctctctcttcctcctcctctctctttccatctcctccctcctcctctctcc

SEQ ID NO: 279671 - DNA, 868 bp, Homo sapiens
  misc_feature (64)..(64): n is a, c, g, or t
  misc_feature (67)..(67): n is a, c, g, or t
  misc_feature (94)..(95): n is a, c, g, or t
  misc_feature (100)..(100): n is a, c, g, or t
  misc_feature (176)..(176): n is a, c, g, or t
  misc_feature (249)..(249): n is a, c, g, or t
  misc_feature (263)..(263): n is a, c, g, or t
  misc_feature (291)..(291): n is a, c, g, or t
  misc_feature (307)..(307): n is a, c, g, or t
  misc_feature (309)..(309): n is a, c, g, or t
  misc_feature (313)..(313): n is a, c, g, or t
  misc_feature (315)..(315): n is a, c, g, or t
  misc_feature (318)..(318): n is a, c, g, or t
  misc_feature (325)..(325): n is a, c, g, or t
  misc_feature (342)..(342): n is a, c, g, or t
  misc_feature (344)..(347): n is a, c, g, or t
  misc_feature (349)..(351): n is a, c, g, or t
  misc_feature (355)..(355): n is a, c, g, or t
gcgaattcggccattatggccggggggctttttttcgccggtccgagaggtggctacattcgtnganggacacagctgcggaattgcggcttgnnagatngaaatcatggcaggtccagaaagtgatgcgcaataccagttcactggtattaaaaaatatttcaactcttatactntcacaggtagaatgaactgtgtactggccacatatggaagcattgcattgattgtcttatatttcaagttaangtccaaaaaaactncagctgtgaaagcaacataatggatttnaaactgtctacggttntnaacntnatntgtaagntcccatgcccggaagangnnnntnnnccgnatcattttcttcttccggccgggccgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctacccgccctgccgccacatgcagtggaggagaggcctgtggcccgaagagcctggtagcgcctcctggggcagcacgtgggtggcgcaggcttagtaacgccgtggactgcagcgacaatcagtggatggtg

SEQ ID NO: 279672 - DNA, 879 bp, Homo sapiens
  misc_feature (64)..(64): n is a, c, g, or t
  misc_feature (67)..(67): n is a, c, g, or t
  misc_feature (94)..(95): n is a, c, g, or t
  misc_feature (100)..(100): n is a, c, g, or t
  misc_feature (176)..(176): n is a, c, g, or t
  misc_feature (249)..(249): n is a, c, g, or t
  misc_feature (263)..(263): n is a, c, g, or t
  misc_feature (291)..(291): n is a, c, g, or t
  misc_feature (307)..(307): n is a, c, g, or t
  misc_feature (309)..(309): n is a, c, g, or t
  misc_feature (313)..(313): n is a, c, g, or t
  misc_feature (315)..(315): n is a, c, g, or t
  misc_feature (318)..(318): n is a, c, g, or t
  misc_feature (325)..(325): n is a, c, g, or t
  misc_feature (342)..(342): n is a, c, g, or t
  misc_feature (344)..(347): n is a, c, g, or t
  misc_feature (349)..(351): n is a, c, g, or t
  misc_feature (355)..(355): n is a, c, g, or t
gcgaattcggccattatggccggggggctttttttcgccggtccgagaggtggctacattcgtnganggacacagctgcggaattgcggcttgnnagatngaaatcatggcaggtccagaaagtgatgcgcaataccagttcactggtattaaaaaatatttcaactcttatactntcacaggtagaatgaactgtgtactggccacatatggaagcattgcattgattgtcttatatttcaagttaangtccaaaaaaactncagctgtgaaagcaacataatggatttnaaactgtctacggttntnaacntnatntgtaagntcccatgcccggaagangnnnntnnnccgnatcattttcttcttccggccgggccgagaggtggttacattcgttgaaggacaccagctgcggaatttgcggctttggcagattgaaatcatggcaggtccagaaagtgatgcgcaataccagttcactggtattaaaaaatataaaaagaactcttaaaactcaacaagaaaacaaaaaatccaattaaaaaatgtacagaagacacagacacttcacaaaagaagatacacagataagcacatgatatgatgtccatcacacgtcattcgggaacggcaaaataaaacaatgaggagttcccgtagtggctcagcagaaacaaattagactagtaaccatgaggttgccagttcaatacctggccttgctcagtgggctaaggatccagtgttgcagggagctgtggtgtaggtcacagacatggctcagatcttgcatcgctgtggccatggtgtagactggcagctgcagctccaattgacccctaccggaagaaggaaaatgatccgggatcctctaat

SEQ ID NO: 279673 - DNA, 562 bp, Homo sapiens
cggacgcgtgggtcgacccacgcgtcgcgttgaaggacaccagctgcggaatttgcggctttggcagacccagctgagtcactgtcactgcctaccaatctcgaccggacctcgaccggctcgtctgtgctgccaatcgactcggcgtggcgtcggtcgtggtagataggcggtcatgcatacgaattttcagctcttgttctggtgaccttttgaatacgtcttgtctataaaagaaattcatgcctttgtaaaatacacagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacc

SEQ ID NO: 279674 - DNA, 3969 bp, Homo sapiens
aaaatgaaacgtacctaagtattattggacagccggagtattttacagtggttgctgctcaggaaatttgagtgaaggactgcaaaagaggagcaaagcagacccgagagagaaggcagcagtgctcccctgtgacgtgctccatcaccgggcagggaagacaccgctgccacctctccacagccttgttcaagagcactggaaattgatggtacaaaacagaagagggaacggaaaaagacagtctcattcagcagcatgccaacagagaagaagatcagcagtgcaagtgattgtattaattcaatggttgagggttcagaactcaaaaaggttcgctccaactctagaatttatcataggtactttttactggatgctgacatgcagagcctaaggtgggagccatctaagaaggattctgagaaagccaagattgacattaaatccatcaaggaagtgagaacaggaaaaaacacagacatattccgcagcaatggcatttctgaccagatatctgaagattgtgcgttttccgtcatatatggagagaattatgagtcactggatttggttgccaactccgcagatgttgcaaacatctgggttacaggactgcggtacctaatttcttatggaaaacatacacttgatatgttagaaagtagccaagataacatgaggacttcttgggtttcacaaatgtttagtgaaattgatgtagataaccttggacatataactctgtgtaatgctgtgcaatgtatcagaaacctcaatcctggtttaaaaacgagcaaaattgagcttaagttcaaagaattgcataaatcaaaggacaaagctggtaccgaggtcacaaaggaagaatttattgaggtttttcatgagctttgtactagacctgaaatttatttccttttagttcagttttcaagcaataaagaattccttgataccaaggaccttatgatgtttcttgaggcagaacagggtgtggcacatataaatgaggaaataagccttgaaattattcacaaatatgaaccatccaaagagggtcaggaaaagggctggctctccatagacgggttcactaattaccttatgtcacctgactgttatatattcgatccagaacataagaaggtctgtcaggatatgaagcaacctctgtctcattactttataaactcatctcataatacatacttaatagaggatcagttccgaggtccctccgacatcacaggatatattcgagctcttaaaatgggttgccggagtgttgaattagatgtatgggatgggccggacaatgaacctgtaatttacacaggccacaccatgacctctcagatagttttccgcagtgtcattgatattattaacaagtatgcattctttgcttcagagtatcctcttatcttgtgtttagaaaaccactgttccattaaacaacagaaggtaatggttcagcacatgaagaaacttttaggagacaagctctatacaacatcacccaatgttgaggaatcttatctaccatccccagatgtcctgaaagggaaaatactaattaaagcaaagaagctgtcctcaaattgctctggggtagaaggagatgttactgacgaagatgaaggagcagaaatgtctcagaggatgggaaaagagaacatggagcaacccaataatgtgcctgtgaagcgatttcagctttgtaaagaactgtctgaactggtcagcatctgcaaatcagttcagttcaaagaatttcaggtgtcgtttcaggttcagaagtactgggaagtctgttcctttaatgaagtgcttgccagcaagtacgccaatgaaaatccaggggactttgtaaattacaacaaacgttttcttgctagggtttttcccagtccaatgagaattgattccagtaacatgaatcctcaagatttttggaaatgtggttgccaaattgtagccatgaactttcagacaccaggactgatgatggacctgaatattggctggtttaggcagaacggaaactgtggctatgtcctccggccagccatcatgagggaggaggtctccttcttcagcgccaatacaaaagactctgtcccaggggtctcacctcaacttcttcacattaaaatcatcagtgggcagaactttcccaagcccaaaggatcaggtgccaaaggtgatgtggtagatccttatgtctatgttgaaatccatggaatccctgctgattgtgcagaacaaaggacaaaaacagtgcaccagaatggagacgctcccatttttgatgaaagctttgaatttcaaatcaacctgcctgaactggccatggtgcgctttgtagtgctggatgatgactacattggggatgaattcatcggccagtacacaattccctttgaatgtttacagacgggctaccgccatgtccccctgcagtccttaactggagaggtccttgcacatgcttctttatttgtccacgtggctattactaaccgaagaggaggaggaaagcctcataaaaggggcctttctgtgagaaaagggaagaaatccagggaatatgcatctttgagaacactgtggattaaaaccgtggatgaggtattcaagaatgcccagccccctatacgggatgccacagatctgagagaaaacatgcagaatgcggtggtgtcattcaaggagctgtgtggcctctcctctgtggccaatctcatgcagtgcatgttggcggtgtctccccgctttctggggcccgataacacacccctagtggtcctaaatctcagcgagcagtaccccacaatggagctgcagggaattgtgccggaggttctgaagaagatcgtaacaacttatgacatgatgattcagtccctcaaggcgttgattgaaaatgcagatgctgtatatgaaaagatcgtacattgtcagaaggcagccatggaattccatgaacacttgcacagcataggcaccaaggaaggtttgaaggaaagaaaactacaaaaagcagtggagagctttacctggaatattaccatcttaaagggacaagcagatcttttgaaatatgctaagaatgagacattggagaacctgaaacaaatccattttgctgctgtttcatgtggactgaataaaccaggcaccgaaaatgctgatgtccagaagccacgccggagcttggaagtcatacccgaaaaagcaaacgatgaaactggagaatgaggaaacttacaataaaccattatggagtttataactctaggaccaattgtagtcagatgggacatttgctttgcactcactaatgagaataatattcgggattttaaagcacaactggaatagctaattacagtctattaaaactgtgaatgtatgtagcaatcctgcgtgtgaaggcaaataaactctttaacaggcaattatattgctggccaaaatatgctatatttgtatacaaagacattctaactcagttccagtatgaagaaagattattcactctagctccactgagaaacattttcctaagtgaaaacaatttcttaagatggaaatggattggattgtcaaattattatttattggagaaaaaaacctgatctacacatttttacttatatggggttgccagagtctctgggttctagatgattttggtggcatgcttgctgagccataattactaaagagaatgtaagtggacgggttccctgaatccccggggtccttggagagccatcgaggagaatgtgcaattggactgaagctccctggctgaagatacatgccgagtcagcacatgggtagagatgatgtaaaagcagccaatctggaaacaatacattgtaaatagtttttcattgtatgaagtagtgttcacattaaaaagatgttttatgatatttctccaatagcagtacatgt

SEQ ID NO: 279675 - DNA, 1041 bp, Homo sapiens
ttaaaattgacctattcagatgcagtgccaataagaaataattatgccttcttgtggaatcagaatacttctatttcagtgaaagatagatattgttgaagtataacactaagttatgtcatatctaatactgtttaattgcatgttttgttatagggacaagcagatcttttgaaatatgctaagaatgagacattggagaacctgaaacaaatccattttgctgctgtttcatgtggactgaataaaccaggcaccgaaaatgctgatgtccagaagccacgccggagcttggaagtcatacccgaaaaagcaaacgatgaaactggagaatgaggaaacttacaataaaccattatggagtttataactctaggaccaattgtagtcagatgggacatttgctttgcactcactaatgagaataatattcgggattttaaagcacaactggaatagctaattacagtctattaaaactgtgaatgtatgtagcaatcctgcgtgtgaaggcaaataaactctttaacaggcaattatattgctggccaaaatatgctatatttgtatacaaagacattctaactcagttccagtatgaagaaagattattcactctagctccactgagaaacattttcctaagtgaaaacaatttcttaagatggaaatggattggattgtcaaattattatttattggagaaaaaaacctgatctacacatttttacttatatggggttgccagagtctctgggttctagatgattttggtggcatgcttgctgagccataattactaaagagaatgtaagtggacgggttccctgaatccccggggtccttggagagccatcgaggagaatgtgcaattggactgaagctccctggctgaagatacatgccgagtcagcacatgggtagagatgatgtaaaagcagccaatctggaaacaatacattgtaaatagtttttcattgtatgaagtagtgttcacattaaaaagatgttttatgatatttctccaatagcagtacatgt

SEQ ID NO: 279676 - DNA, 3644 bp, Homo sapiens
  misc_feature (40)..(40): n is a, c, g, or t
ccgcgcgcggcggcccgaggcggcggcggggacgcggggncgcgaggacgcggctttgtgcaggcgggtcgcggggcgcccatggcggagtgcggccgggggggcgccgccggcggggccctgcccacctccccgggcccggccctcggcgccaagggcgccctgaaagccggagtgggggaaggcggtggcgggggaggtcgcctcggccacgggcgggcgcgctatgacagcggcggggtttccaacggagactgcagcctcggcgtgtccggggacgaagcccgggctagccctaccaggggaccccgcggcgttgcgctcgccccgacccccagcgcggtcgtctgtaccctcccccgggagagcaagccgggcggcctgccccgccggagcagcatcatcaaggatggtacaaaacagaagagggaacggaaaaagacagtctcattcagcagcatgccaacagagaagaagatcagcagtgcaagtgattgtattaattcaatggttgagggttcagaactcaaaaaggttcgctccaactctagaatttatcataggtactttttactggatgctgacatgcagagcctaaggtgggagccatctaagaaggattctgagaaagccaagattgacattaaatccatcaaggaagtgagaacaggaaaaaacacagacatattccgcagcaatggcatttctgaccagatatctgaagattgtgcgttttccgtcatatatggagagaattatgagtcactggatttggttgccaactccgcagatgttgcaaacatctgggttacaggactgcggtacctaatttcttatggaaaacatacacttgatatgttagaaagtagccaagataacatgaggacttcttgggtttcacaaatgtttagtgaaattgatgtagataaccttggacatataactctgtgtaatgctgtgcaatgtatcagaaacctcaatcctggtttaaaaacgagcaaaattgagcttaagttcaaagaattgcataaatcaaaggacaaagctggtaccgaggtcacaaaggaagaatttattgaggtttttcatgagctttgtactagacctgaaatttatttccttttagttcagttttcaagcaataaagaattccttgataccaaggaccttatgatgtttcttgaggcagaacagggtgtggcacatataaatgaggaaataagccttgaaattattcacaaatatgaaccatccaaagagggtcaggaaaagggctggctctccatagacgggttcactaattaccttatgtcacctgactgttatatattcgatccagaacataagaaggtctgtcaggatatgaagcaacctctgtctcattactttataaactcatctcataatacatacttaatagaggatcagttccgaggtccctccgacatcacaggatatattcgagctcttaaaatgggttgccggagtgttgaattagatgtatgggatgggccggacaatgaacctgtaatttacacaggccacaccatgacctctcagatagttttccgcagtgtcattgatattattaacaagtatgcattctttgcttcagagtatcctcttatcttgtgtttagaaaaccactgttccattaaacaacagaaggtaatggttcagcacatgaagaaacttttaggagacaagctctatacaacatcacccaatgttgaggaatcttatctaccatccccagatgtcctgaaagggaaaatactaattaaagcaaagaagctgtcctcaaattgctctggggtagaaggagatgttactgacgaagatgaaggagcagaaatgtctcagaggatgggaaaagagaacatggagcaacccaataatgtgcctgtgaagcgatttcagctttgtaaagaactgtctgaactggtcagcatctgcaaatcagttcagttcaaagaatttcaggtgtcgtttcaggttcagaagtactgggaagtctgttcctttaatgaagtgcttgccagcaagtacgccaatgaaaatccaggggactttgtaaattacaacaaacgttttcttgctagggtttttcccagtccaatgagaattgattccagtaacatgaatcctcaagatttttggaaatgtggttgccaaattgtagccatgaactttcagacaccaggactgatgatggacctgaatattggctggtttaggcagaacggaaactgtggctatgtcctccggccagccatcatgagggaggaggtctccttcttcagcgccaatacaaaagactctgtcccaggggtctcacctcaacttcttcacattaaaatcatcagtgggcagaactttcccaagcccaaaggatcaggtgccaaaggtgatgtggtagatccttatgtctatgttgaaatccatggaatccctgctgattgtgcagaacaaaggacaaaaacagtgcaccagaatggagacgctcccatttttgatgaaagctttgaatttcaaatcaacctgcctgaactggccatggtgcgctttgtagtgctggatgatgactacattggggatgaattcatcggccagtacacaattccctttgaatgtttacagacgggctaccgccatgtccccctgcagtccttaactggagaggtccttgcacatgcttctttatttgtccacgtggctattactaaccgaagaggaggaggaaagcctcataaaaggggcctttctgtgagaaaagggaagaaatccagggaatatgcatctttgagaacactgtggattaaaaccgtggatgaggtattcaagaatgcccagccccctatacgggatgccacagatctgagagaaaacatgcagaatgcggtggtgtcattcaaggagctgtgtggcctctcctctgtggccaatctcatgcagtgcatgttggcggtgtctccccgctttctggggcccgataacacacccctagtggtcctaaatctcagcgagcagtaccccacaatggagctgcagggaattgtgccggaggttctgaagaagatcgtaacaacttatgacatgatgattcagtccctcaaggcgttgattgaaaatgcagatgctgtatatgaaaagatcgtacattgtcagaaggcagccatggaattccatgaacacttgcacagcataggcaccaaggaaggtttgaaggaaagaaaactacaaaaagcagtggagagctttacctggaatattaccatcttaaagataagaaagacaggaaggaggagtatttttgtgcctcagactcccataatggtatgagtaccctcctccttctcctccctcacactgcatgtgatttggaagaaaagtgtctgctggcccccagggaatggaaggtgctaatctttgctgtcttcaacatccaagcatgtggccattacacaggtggcagagggcaggggaagtcttagctgccgcactggatccctcacctcagaagtaagtcaactttttttctctaatagatagttggacaaaaggactttgaaaaaattagccagatgtagaatccctgttgttttgcccctacgtctgaataaaagcaatgacttgtgattgtt

SEQ ID NO: 279677 - DNA, 4170 bp, Homo sapiens
  misc_feature (40)..(40): n is a, c, g, or t
ccgcgcgcggcggcccgaggcggcggcggggacgcggggncgcgaggacgcggctttgtgcaggcgggtcgcggggcgcccatggcggagtgcggccgggggggcgccgccggcggggccctgcccacctccccgggcccggccctcggcgccaagggcgccctgaaagccggagtgggggaaggcggtggcgggggaggtcgcctcggccacgggcgggcgcgctatgacagcggcggggtttccaacggagactgcagcctcggcgtgtccggggacgaagcccgggctagccctaccaggggaccccgcggcgttgcgctcgccccgacccccagcgcggtcgtctgtaccctcccccgggagagcaagccgggcggcctgccccgccggagcagcatcatcaaggatggtacaaaacagaagagggaacggaaaaagacagtctcattcagcagcatgccaacagagaagaagatcagcagtgcaagtgattgtattaattcaatggttgagggttcagaactcaaaaaggttcgctccaactctagaatttatcataggtactttttactggatgctgacatgcagagcctaaggtgggagccatctaagaaggattctgagaaagccaagattgacattaaatccatcaaggaagtgagaacaggaaaaaacacagacatattccgcagcaatggcatttctgaccagatatctgaagattgtgcgttttccgtcatatatggagagaattatgagtcactggatttggttgccaactccgcagatgttgcaaacatctgggttacaggactgcggtacctaatttcttatggaaaacatacacttgatatgttagaaagtagccaagataacatgaggacttcttgggtttcacaaatgtttagtgaaattgatgtagataaccttggacatataactctgtgtaatgctgtgcaatgtatcagaaacctcaatcctggtttaaaaacgagcaaaattgagcttaagttcaaagaattgcataaatcaaaggacaaagctggtaccgaggtcacaaaggaagaatttattgaggtttttcatgagctttgtactagacctgaaatttatttccttttagttcagttttcaagcaataaagaattccttgataccaaggaccttatgatgtttcttgaggcagaacagggtgtggcacatataaatgaggaaataagccttgaaattattcacaaatatgaaccatccaaagagggtcaggaaaagggctggctctccatagacgggttcactaattaccttatgtcacctgactgttatatattcgatccagaacataagaaggtctgtcaggatatgaagcaacctctgtctcattactttataaactcatctcataatacatacttaatagaggatcagttccgaggtccctccgacatcacaggatatattcgagctcttaaaatgggttgccggagtgttgaattagatgtatgggatgggccggacaatgaacctgtaatttacacaggccacaccatgacctctcagatagttttccgcagtgtcattgatattattaacaagtatgcattctttgcttcagagtatcctcttatcttgtgtttagaaaaccactgttccattaaacaacagaaggtaatggttcagcacatgaagaaacttttaggagacaagctctatacaacatcacccaatgttgaggaatcttatctaccatccccagatgtcctgaaagggaaaatactaattaaagcaaagaagctgtcctcaaattgctctggggtagaaggagatgttactgacgaagatgaaggagcagaaatgtctcagaggatgggaaaagagaacatggagcaacccaataatgtgcctgtgaagcgatttcagctttgtaaagaactgtctgaactggtcagcatctgcaaatcagttcagttcaaagaatttcaggtgtcgtttcaggttcagaagtactgggaagtctgttcctttaatgaagtgcttgccagcaagtacgccaatgaaaatccaggggactttgtaaattacaacaaacgttttcttgctagggtttttcccagtccaatgagaattgattccagtaacatgaatcctcaagatttttggaaatgtggttgccaaattgtagccatgaactttcagacaccaggactgatgatggacctgaatattggctggtttaggcagaacggaaactgtggctatgtcctccggccagccatcatgagggaggaggtctccttcttcagcgccaatacaaaagactctgtcccaggggtctcacctcaacttcttcacattaaaatcatcagtgggcagaactttcccaagcccaaaggatcaggtgccaaaggtgatgtggtagatccttatgtctatgttgaaatccatggaatccctgctgattgtgcagaacaaaggacaaaaacagtgcaccagaatggagacgctcccatttttgatgaaagctttgaatttcaaatcaacctgcctgaactggccatggtgcgctttgtagtgctggatgatgactacattggggatgaattcatcggccagtacacaattccctttgaatgtttacagacgggctaccgccatgtccccctgcagtccttaactggagaggtccttgcacatgcttctttatttgtccacgtggctattactaaccgaagaggaggaggaaagcctcataaaaggggcctttctgtgagaaaagggaagaaatccagggaatatgcatctttgagaacactgtggattaaaaccgtggatgaggtattcaagaatgcccagccccctatacgggatgccacagatctgagagaaaacatgcagaatgcggtggtgtcattcaaggagctgtgtggcctctcctctgtggccaatctcatgcagtgcatgttggcggtgtctccccgctttctggggcccgataacacacccctagtggtcctaaatctcagcgagcagtaccccacaatggagctgcagggaattgtgccggaggttctgaagaagatcgtaacaacttatgacatgatgattcagtccctcaaggcgttgattgaaaatgcagatgctgtatatgaaaagatcgtacattgtcagaaggcagccatggaattccatgaacacttgcacagcataggcaccaaggaaggtttgaaggaaagaaaactacaaaaagcagtggagagctttacctggaatattaccatcttaaagggacaagcagatcttttgaaatatgctaagaatgagacattggagaacctgaaacaaatccattttgctgctgtttcatgtggactgaataaaccaggcaccgaaaatgctgatgtccagaagccacgccggagcttggaagtcatacccgaaaaagcaaacgatgaaactggagaatgaggaaacttacaataaaccattatggagtttataactctaggaccaattgtagtcagatgggacatttgctttgcactcactaatgagaataatattcgggattttaaagcacaactggaatagctaattacagtctattaaaactgtgaatgtatgtagcaatcctgcgtgtgaaggcaaataaactctttaacaggcaattatattgctggccaaaatatgctatatttgtatacaaagacattctaactcagttccagtatgaagaaagattattcactctagctccactgagaaacattttcctaagtgaaaacaatttcttaagatggaaatggattggattgtcaaattattatttattggagaaaaaaacctgatctacacatttttacttatatggggttgccagagtctctgggttctagatgattttggtggcatgcttgctgagccataattactaaagagaatgtaagtggacgggttccctgaatccccggggtccttggagagccatcgaggagaatgtgcaattggactgaagctccctggctgaagatacatgccgagtcagcacatgggtagagatgatgtaaaagcagccaatctggaaacaatacattgtaaatagtttttcattgtatgaagtagtgttcacattaaaaagatgttttatgatatttctccaatagcagtacatgt

SEQ ID NO: 279678 - DNA, 1387 bp, Homo sapiens
ctccctgctcagggcactggggggctctccacccactgccactctcaggctggcatgcgagaatgcccagccccctatacgggatgccacagatctgagagaaaacatgcagaatgcggtggtgtcattcaaggagctgtgtggcctctcctctgtggccaatctcatgcagtgcatgttggcggtgtctccccgctttctggggcccgataacacacccctagtggtcctaaatctcagcgagcagtaccccacaatggagctgcagggaattgtgccggaggttctgaagaagatcgtaacaacttatgacatgatgattcagtccctcaaggcgttgattgaaaatgcagatgctgtatatgaaaagatcgtacattgtcagaaggcagccatggaattccatgaacacttgcacagcataggcaccaaggaaggtttgaaggaaagaaaactacaaaaagcagtggagagctttacctggaatattaccatcttaaagggacaagcagatcttttgaaatatgctaagaatgagacattggagaacctgaaacaaatccattttgctgctgtttcatgtggactgaataaaccaggcaccgaaaatgctgatgtccagaagccacgccggagcttggaagtcatacccgaaaaagcaaacgatgaaactggagaatgaggaaacttacaataaaccattatggagtttataactctaggaccaattgtagtcagatgggacatttgctttgcactcactaatgagaataatattcgggattttaaagcacaactggaatagctaattacagtctattaaaactgtgaatgtatgtagcaatcctgcgtgtgaaggcaaataaactctttaacaggcaattatattgctggccaaaatatgctatatttgtatacaaagacattctaactcagttccagtatgaagaaagattattcactctagctccactgagaaacattttcctaagtgaaaacaatttcttaagatggaaatggattggattgtcaaattattatttattggagaaaaaaacctgatctacacatttttacttatatggggttgccagagtctctgggttctagatgattttggtggcatgcttgctgagccataattactaaagagaatgtaagtggacgggttccctgaatccccggggtccttggagagccatcgaggagaatgtgcaattggactgaagctccctggctgaagatacatgccgagtcagcacatgggtagagatgatgtaaaagcagccaatctggaaacaatacattgtaaatagtttttcattgtatgaagtagtgttcacattaaaaagatgttttatgatatttctccaatagcagtacatgt

SEQ ID NO: 279679 - DNA, 437 bp, Homo sapiens
ccatctcgactaaaaatacaaggcttcttcttctgcattgtacaggatcaggaagaaaggaaggggaaaatgtgaagtgtttctctatttaatgaatcagctgtggccaacttgttcagatgcgtctggactttcttccttccagtgggtttgtggtcttgcttgactttaggagtgaagccgcagaccttcgcagtgagtgttacagctcttaaaggtggcagtccggagttgttcgttcctctcggtgggttcgtggtctcactgacttcaggagtgaagctacagaccttcacgccacctctgtactccaggccatcaaatgccagcctcctgtaaatacactctgatttcctgaaaacactcttattcccctccaaactacaaagtgatctttaataaatgcaaattgatcagtcatctgatcaaaatctgtt

SEQ ID NO: 279680 - DNA, 1181 bp, Homo sapiens
gctgagcccaccaccgggggccgcggttcagctccgccgggcgccccaggctgccgagtccgctgggtcctacgcgaccgctgacccgcagcgccgccggctcccgtcgccgtagccaccgccagctcggtgcagcccaggcgtttccgggttcccgcggtcccgtcccccaaatgctccggcttccgcctcggctctggcaaatgccgttcccggctcggctctggcagccccagctcggcacttggcagctctgtccctaaggcgacgcacctgggctgctctgctggcagcccctggttcctgcttcaccgtcgcgtggaggcctggggcactgctttctgctacacctctcctaggagcgcgaaacagatggagtgacactcgtcgagggcctctgcgggactgtctgtttgcagagggtgccaaggtgtccactgcgtaaggaagggcaaagtcctttggggcaaagaaccctgagaggaacggggagatggattttgaaagcaaacgaaccctctcctaaaagtgactgtcactgacctgaaaacaaccagattagctatggcaaaggctgccaaccaaccagtggtctgcaagaaggcttgttcttccacttcacccaccctgactgagatcttgagactgaaggaaacccaaagccgtaccaccaatgggcctagtgtcatcaaccgggagaggaaaaagaaaactgggcccagaggattgcagagttatgagggaccaaccccttcctggctgcatggatcacagcattaccttttaaaagtgttccagtagctgtgttggaaaccctctaaccacggcagcccattcaggtgatgaacaggctgaaatcagtacttcaggttcagctggattatcaaataagcgaataggattatctctttttgttaactcagggctgctataaattaagcctatgtctctttatattgcaaatgattaaaaccatgtccaagagagacatacttagaaaaaaagtgatattgaagaaaaataagtaactgtattagagtagaataactggttttaaaattttctgcaatacagtcttgagaaaattcctggatggtaaaatacatattagatcttaatacatgcccagttttttttgaaaccaaaatgtgcctgttagatgatgataacagcatgcctcg

SEQ ID NO: 279681 - DNA, 940 bp, Homo sapiens
gctgagcccaccaccgggggccgcggttcagctccgccgggcgccccaggctgccgagtccgctgggtcctacgcgaccgctgacccgcagcgccgccggctcccgtcgccgtagccaccgccagctcggtgcagcccaggcgtttccgggttcccgcggtcccgtcccccaaatgctccggcttccgcctcggctctggcaaatgccgttcccggctcggctctggcagccccagctcggcacttggcagctctgtccctaaggcgacgcacctgggctgctctgctggcagcccctggttcctgcttcaccgtcgcgtggaggcctggggcactgctttctgctacacctctcctaggagcgcgaaacagatggagtgacactcgtcgagggcctctgcgggactgtctgtttgcagagggtgccaaggtgtccactgcgtaaggaagggcaaagtcctttggggcaaagaaccctgagaggaacggggagatggattttgaaagcaaacgaaccctctcctaaaagtgactgtcactgacctgaaaacaaccagattagctatggcaaaggctgccaaccaaccagtggtctgcaagaaggcttgttcttccacttcacccaccctgactgagatcttgagactgaaggaaacccaaagccgtaccaccaatgggcctagtgtcatcaaccgggagaggaaaaagaaaactgggcccagaggattgcagagttatgagggaccaaccccttcctggctgcatggatcacagcattaccttttaaaagtgttccagtagctgtgttggaaaccctctaaccacggcagcccattcagccatgtaagcaagtacctttcacctcccgccatgattctgaggcctcccccgccatgtggaactgtaggtccaattaaacttctttttcttcccagtctcg

SEQ ID NO: 279682 - DNA, 577 bp, Homo sapiens
tactccaatacagaatgggaaagaggaattcccaagtagtaaggtatcccagagccggaacatttcatctaatcttcccctgcctttagactgggatttgtatcaccagcttcctggttctcagacctttggaatcagaattacaaacacctctagactctcaattataccactggctttcctgggtatccagctttcaaacagcatattgtgggatatctcagcctccataaatgtgtgagccaattactcataataaatctcctctatctatgtttatatatctcctattggttctgtttctctagagaaccctaatacagtcctcataagttttgaggtactcttaattgtatttttaagaattaattagatactttttaaatgttcaaaatgtctcaataaaaggtattatgaagcatgtgctttttgttaccacttaattaacaggatgcttcataacagactaaaagtaataagatctaatattaccattattaataatttgacaaatttattctcctaagtttactacctagaaatatatacatacacacatatatagctatatatatag

SEQ ID NO: 279683 - DNA, 2992 bp, Homo sapiens
  misc_feature (1031)..(1031): n is a, c, g, or t
  misc_feature (1735)..(1735): n is a, c, g, or t
  misc_feature (2088)..(2088): n is a, c, g, or t
  misc_feature (2095)..(2095): n is a, c, g, or t
ttttttttttaagatttaaaacattttttattaaaactgtacaataatttacaaacgagtaaaaaattctctggtatatatcataggaatcacaatacaaaaatatttgtaaaatcttgtagatcaccatacaaacctattttaggcctgtgaatactgcttagcatggaacggaatgtcacgtggttagagggtgactatgaagggagtgcctgggagaatacacacactacctggcatgccgccgtaagaaaacaggcccggttagtttttgcataaatttacaataaagctttttaaaaaatatacagtaaacaaatatatgatttgatacctatattcacaatatgagtttcctgaggctaaactgaattccattactgtgataaaacacacactctctctcagggtttcaaggatgggatgacggtgagttggcgaatgcgtcagtgcctccaaacccacacttgggcactctcttctttttgacttctagtatcggtgttcacaagccctgtaaggcactcggggtatcctgaaggctacagattctgcaagggcagagactttaaggaacagccatagtccttctccagctcaaaatctggaccatgggcacaaggtaaacaacacactggtgtcaacaaaggaatctgctatttatgtggatttttactttagacaaactaaagtatctatgttgttctgtgtgttgaacacagagtgtgatgatgttaatataatgtaaatgttgatgtaacagtacatttctggcaacatttcagggtccttcctcttgccttattagggggtgatgcattcatacagacttcccctgttagaagagctagcagtaagacagcccaagtacttggaggaaattcactctagcccattggtttggaaaagaaggtatagcctgcaatttagaaatgcaccttatttttaaatacttgaattctgctgctgctcactggaccaggaggagtcagtgataaatgctcatatttacctttttgggggcaaaaacncagttctgaaatgctgggtattgtaatcagatgtaaagaaggtgcctatgatagacgagtgaaaacaatgatatctaaggagaggaactgacgctccaactagatgtgtgctttcaggaatggggcagagacgcgatgcagtttggatgttattcagcacattccttgcaccttctcccgttcctatatacatactttttacatataaacaattacaacttcataaggatttggtacatatttacatgcttctctttgccgtatagtttgccttattattacagaactgtgattaagagtgtctgtggtggatagaggtgtatgaagtgctccagacatatatacaacatgctaaaccatgatgacccaaataaacatgagggatgtgaatctgggaatgtgagtttcactgcacatctttagatccgaaacagctggcccatgcagctgttgttcccatgcaggtacacattgggaccatgccaggagctctcccagaggaggaggccaggctggcagggagccaggtagagttacaacatatttctggatgcctgcatcgtagagtccatcggacttcaacccagcggttcacccacagcgccacggtagcttttattaacacaaggctattgtgtgccattcagttgtgagtataataaatgtgccaagaagatgcagtcgttaaaatgagacaaaactangcacagaggactaaacaggatttcagactcgagacgcaaaccccgaggtcaggctcagctagagacactgaactggcccagtatcttgccgagtaaatcaggaactgtggcttgaatgacaacagaaatggatgggtctttcttggacaagtgctgattaatagtgcattttccagcaaaaatcctgcagccaccaaagaaaaagcatatctgtctgatactattagcttttccctgatttcaacctagggagccatgcctggtccgcagccaccgtgtcatctgccccaaagtcagacatttcttctgacacaaatataaaatgagcctaatacttccagacaacccagtcntccctanggcagctgagtcgtgtcttttatacaatgctgccagtaacagtcacacctggctgcacagctggctgcctcaacttctaggtgcctcgaaatggctaaatcccacgaatggctcttctggttgcgtgaaaacatgcataaacgcatgcttgtgcacacaagtgagcacacacacacacctcctgtcaattcagctctgagagcagaaccttagcccacctagggtgggaggacacagaagttccatctgcagccagtcaggctccatccacaggctggacgaagctcccgggctgcgtcccgggtctcccagcaggaatggaaatcacacctaacgttgccttcaccaatgcactgcttcctctctgaaaaagagtggagaaaacgccgtttagtgcgacgacctggggaatgtgtgtgacccaccacaggtcagcactcaaggcagttggggccttgaccaggcactggctctgcacaggatggtcactgagccaatggcaggcactgccctcatgggtccagcaccagctacagcgccacgtcctgagcctccagcccgggagacgcacctggcacccaccgaaggccacactctcaggaagatgagtccatgctcctcacaaagcccctacagaagtgaccttggatctttctcaccatgtctgggccagcagcccggtttctacccaacttccctcattgcttagaaagtgggcctctgctaagttcaaagtttttattacctttccattttttcatgtttttgaagaagttatgaaggatctgcttttcacaagggcgggccccggatcagtccctggggcatggcagcatcgggtgggaggccacgtgggctgaggggcgggagcgagggcacgctgggacagaggcagag

SEQ ID NO: 279684 - DNA, 675 bp, Homo sapiens
gctctcgaaggcgtcctccacgcagcggaacacgcagccaagcttgggccgggccagaggcctcgcgggctcctgaggctgccgcgcggtcacggcaggagcgggcgacagaatccggtctcggagcctcctgtagcgagccacaggagggagcctcccaggtggtcgaccggagccaggtgctgccaggcacccgactgcagagcttgccctccaggtgatctcgcagtatcggtgttcacaagccctgtaaggcactcggggtatcctgaaggctacagattctgcaagggcagagactttaaggaacagccatagtccttctccagctcaaaatctggaccatgggcacaaggttgtcccggaaccatcgatctctagaaggtacaggaggaaggggacctgccagtccagccctcatattttacagagggaaaaggtgaagccccatgtaaaacagggatttccctcggtgacacttccaggctgagaagggccggggatctggacacctacccagaaacactcccaccctgtcaatgcctctctgaattatgtgatcaactgcctggagtatgaactaggcacatgcaaatagagaacagaggtcttgttgaaaatataatgctgaattttaaaaactcactccccaaattaaaggaacaagaccagagc

SEQ ID NO: 279685 - DNA, 2725 bp, Homo sapiens
  misc_feature (764)..(764): n is a, c, g, or t
  misc_feature (1468)..(1468): n is a, c, g, or t
  misc_feature (1821)..(1821): n is a, c, g, or t
  misc_feature (1828)..(1828): n is a, c, g, or t
gctctcgaaggcgtcctccacgcagcggaacacgcagccaagcttgggccgggccagaggcctcgcgggctcctgaggctgccgcgcggtcacggcaggagcgggcgacagaatccggtctcggagcctcctgtagcgagccacaggagggagcctcccaggtggtcgaccggagccaggtgctgccaggcacccgactgcagagcttgccctccaggtgatctcgcagtatcggtgttcacaagccctgtaaggcactcggggtatcctgaaggctacagattctgcaagggcagagactttaaggaacagccatagtccttctccagctcaaaatctggaccatgggcacaaggtaaacaacacactggtgtcaacaaaggaatctgctatttatgtggatttttactttagacaaactaaagtatctatgttgttctgtgtgttgaacacagagtgtgatgatgttaatataatgtaaatgttgatgtaacagtacatttctggcaacatttcagggtccttcctcttgccttattagggggtgatgcattcatacagacttcccctgttagaagagctagcagtaagacagcccaagtacttggaggaaattcactctagcccattggtttggaaaagaaggtatagcctgcaatttagaaatgcaccttatttttaaatacttgaattctgctgctgctcactggaccaggaggagtcagtgataaatgctcatatttacctttttgggggcaaaaacncagttctgaaatgctgggtattgtaatcagatgtaaagaaggtgcctatgatagacgagtgaaaacaatgatatctaaggagaggaactgacgctccaactagatgtgtgctttcaggaatggggcagagacgcgatgcagtttggatgttattcagcacattccttgcaccttctcccgttcctatatacatactttttacatataaacaattacaacttcataaggatttggtacatatttacatgcttctctttgccgtatagtttgccttattattacagaactgtgattaagagtgtctgtggtggatagaggtgtatgaagtgctccagacatatatacaacatgctaaaccatgatgacccaaataaacatgagggatgtgaatctgggaatgtgagtttcactgcacatctttagatccgaaacagctggcccatgcagctgttgttcccatgcaggtacacattgggaccatgccaggagctctcccagaggaggaggccaggctggcagggagccaggtagagttacaacatatttctggatgcctgcatcgtagagtccatcggacttcaacccagcggttcacccacagcgccacggtagcttttattaacacaaggctattgtgtgccattcagttgtgagtataataaatgtgccaagaagatgcagtcgttaaaatgagacaaaactangcacagaggactaaacaggatttcagactcgagacgcaaaccccgaggtcaggctcagctagagacactgaactggcccagtatcttgccgagtaaatcaggaactgtggcttgaatgacaacagaaatggatgggtctttcttggacaagtgctgattaatagtgcattttccagcaaaaatcctgcagccaccaaagaaaaagcatatctgtctgatactattagcttttccctgatttcaacctagggagccatgcctggtccgcagccaccgtgtcatctgccccaaagtcagacatttcttctgacacaaatataaaatgagcctaatacttccagacaacccagtcntccctanggcagctgagtcgtgtcttttatacaatgctgccagtaacagtcacacctggctgcacagctggctgcctcaacttctaggtgcctcgaaatggctaaatcccacgaatggctcttctggttgcgtgaaaacatgcataaacgcatgcttgtgcacacaagtgagcacacacacacacctcctgtcaattcagctctgagagcagaaccttagcccacctagggtgggaggacacagaagttccatctgcagccagtcaggctccatccacaggctggacgaagctcccgggctgcgtcccgggtctcccagcaggaatggaaatcacacctaacgttgccttcaccaatgcactgcttcctctctgaaaaagagtggagaaaacgccgtttagtgcgacgacctggggaatgtgtgtgacccaccacaggtcagcactcaaggcagttggggccttgaccaggcactggctctgcacaggatggtcactgagccaatggcaggcactgccctcatgggtccagcaccagctacagcgccacgtcctgagcctccagcccgggagacgcacctggcacccaccgaaggccacactctcaggaagatgagtccatgctcctcacaaagcccctacagaagtgaccttggatctttctcaccatgtctgggccagcagcccggtttctacccaacttccctcattgcttagaaagtgggcctctgctaagttcaaagtttttattacctttccattttttcatgtttttgaagaagttatgaaggatctgcttttcacaagggcgggccccggatcagtccctggggcatggcagcatcgggtgggaggccacgtgggctgaggggcgggagcgagggcacgctgggacagaggcagag

SEQ ID NO: 279686 - DNA, 805 bp, Homo sapiens
tcgacggcgacgcgaatctacgcgacgcgacgcggagctcggagcagcgttccttccctctcgtagaggctcaggcgcaggcaccgccccacggcgaggcgcgtcccttagcagagcccgccctgtctctgcggcagcctatcgacgccagcccgcgggccgatcctgttcccgcccccgaccggagcctttcgggtggctccgcccacagcgggcgtttcctcaagccacgcctgcgcaggtcgtcgggggagactgatgaagagacgactatccccagaccgtattttaactactatggcgctgtgtaagaagcaacctgagaagtgtggatgaaaagctacaggtagagccctgggcccaagacggtggcttggacaacatgctaaataaactataaactagatggtatttgaagctacgagagtagataaaaatgacaggaggaccaaggagaaacttgggaacgccaatgtttaagaaacgggaaagcaaaaaaaaaaaaaaacacacacaaaaaaacaatgtaaccagagccacaaaaaccagaatcacagcaagggattctgatgtttacattatgtcctgtttccatgttgacacattacacaaggacagtttttttctaattgcttaatttttcatcatcttccatccgatttactgaaccatccttaactttaggatgaatcctttcatttaacaaatgtgttttgaatgtccactatgtgccagacactgttctaggtgctaggaaaacagctgtgaacaaaaccaataaaaatctctttcctcatggaattta

SEQ ID NO: 279687 - DNA, 392 bp, Homo sapiens
ctcctccttcttgcaggaatatgtttcagttatttgcaacctaaaggaatctgactagaatgtaaaatcattgacctagtaatatgattgctagtctgagcctggaggtagctcccgtttacttccaaggcttgccaaagattcaaatggagttaccaggaattgtaagtttagtcagtctgaattatgcaaaatgttaaccaaaagctacactgacctttgatgtctgaatttcctcatcaacaggctaatccttgacagaaacactggaaggatttcttctctgcaaaactaccctcttccttcacgctgaatcatcagaaagaggagccggctgcatccctaaattcatcccttattttaattaacccaaggatgacatggaggccttg

SEQ ID NO: 279688 - DNA, 943 bp, Homo sapiens
tcgacggcgacgcgaatctacgcgacgcgacgcggagctcggagcagcgttccttccctctcgtagaggctcaggcgcaggcaccgccccacggcgaggcgcgtcccttagcagagcccgccctgtctctgcggcagcctatcgacgccagcccgcgggccgatcctgttcccgcccccgaccggagcctttcgggtggctccgcccacagcgggcgtttcctcaagccacgcctgcgcaggtcgtcgggggagactgatgaagagacgactatccccagaccgtattttaactactatggcgctgtgtaagaagcaacctgagaagtgtggatgaaaagctacagcttccctgctgaaataccttagtgagaatgcataaaaaccaactctaaatgatgcacaaagccaccgagagctaatccttgacagaaacactggaaggatttcttctctgcaaaactaccctcttccttcacgctgaatcatcagaaagaggagccggctgcatccctaaattcatcccttattttaattaacccaaggatgacatggaggccttggagaccctatacagtgctgtgtgttcagcagtaaatatccacccattgtagtcaggagccagcatcttcatcatcctttcttgttagaacaaacttgtccaacccatggcccacgggccacatgtggcctaggacggctttgaatgcggcccaacacaaatttgtaaagtttcttaaaacattaggagatttttttgtgatttttttaagctcatcagctattgtgttagagtattttatgtgtggcccaagacaattcttcttcttccaatgtggcccagggaagccgaaagatcggacacccctatgttagaacaccaaggtctattactttgaagttgttatcctggattaccaatcagaatttgtgttttcaccatt

SEQ ID NO: 279689 - DNA, 721 bp, Homo sapiens
tctatttacaattagttgcatattatgcaatttgatgggttttccagagtttatttagtcctgtctcccaatctcccaacctgggttattttcaatcttttgttgataagtaaacaatgctgcaaaaaataacctgcatatatatcacttcatattaatacaggcacctactgatgggactaaacagggctctgcgcatgacaggtagtaagagcacaaggaattctataggacagatttccaagagcagaactgctggatcaaatggcgttctgaaatcaagattccagaggctacaggtatctgcatacagtacctgaatctgctccaggacttctcgccgcatctccacagccatatggtatacatgatgatcagagtcattgtacattacagcattttggaacatcagcatcaggtctcgcaggaattgggccatggtgcgaatccgacccttagagagatttctcttcaggctagttaagtccatgggtctgcaggtggccaagaaaaaacaaagaaaatcaaaccttcatgtggaacatatgataacctaacacgttctcttgaagaactaaccagttcttaatgaaaacagtagcaaagataacaaccctcatcagataataaaatagcaacagcagttaatatttgcctgtttacaatgggccaaacactgtatttctatactaactcacttaatcctctcaataaacctgta

SEQ ID NO: 279690 - DNA, 628 bp, Homo sapiens
tctatttacaattagttgcatattatgcaatttgatgggttttccagagtttatttagtcctgtctcccaatctcccaacctgggttattttcaatcttttgttgataagtaaacaatgctgcaaaaaataacctgcatatatatcacttcatattaatacaggcacctactgatgggactaaacagggctctgcgcatgacaggtagtaagagcacaaggaattctataggacagatttccaagagcagaactgctggatcaaatggtaagtccatctgttgtattggtagataactgccagattccctttgataggggttgtgccatttacttttatatttttgccaaatggaatctcagtgtagttttaacttgctttttttcccacctaaagattgagcatcttttcatatatttaaaaaatgtttttccttttctgtgaccatccatctgttctgcccatttttctactaatttatttttatctttttctaggagctctttatgtattaagaagacaagccctttgtctatgagttgcaaatctttttcccaagtttgttgtgttttgactttgcttatggtgtttatttcattgtgcagaaattttttgtttatataatctt

SEQ ID NO: 279691 - DNA, 867 bp, Homo sapiens
ctcgccgtcagccgccgcctccatgtgcgagcagaggatgtgctgcagctgcgtgtactccacctccgtcatctccaccaggctcagtgagccctttggctgcacaggtcacggtctggagctgttggaggaggctgctcagagctgttgctgccccaccagacacttggccaaggggcctgcaccggtctgcgcgggaacgtcccaccggcgtctgctcatggctgggctgtggacccatacgcttgttcggaagccaagctctggcccacaggcgaccagaggaagctcgcaggccaggcgccagctccccgagcctgtccctgcagccgcgctgtgtgcaggcacgtgggccaccgcgtctcctccactggcactgctgggtctgggccgccaagcccacctgcccacctgcatcctcagcagcagcacgccccgcagtcggcgggtgcacactctgctgcagcctggatgggctggggcctcggggctcactccccaaccatgagactccttcaccgcagttgaggctgttgcagtggtctcgggctcccactcagccccaggagagggtctgaagggggtgagtccctcctcccgaccttcctgcccatcgtctccagagctggatggtgctgggtccccacagggagcgagacagctgccccgtgacggaaggatgtggggacccgcacccggccggtctcaccctgggctcagcatgagttcagggaggggtccaaagggcactcctgcccacgcccaggcaaaccagcaacaagaaactgggtggccagggcgtccgtgcacgaccccaaacttctccgcgttagaaaaaggctgatgaagacccgagacagaaacttc

SEQ ID NO: 279692 - DNA, 294 bp, Homo sapiens
gctgtgtgtgcccttgtctcacacgccgtgtgtgtccgcgcccttttgtggcgtggcagcttatgtgcgtgcagacagacgccctgtatgtgtgcctccctccacgacagcctccgtgcgcgcgcgcctgcgtgtgtggcaggacatggcctgtgcctttcagctctgtgagaggctatttctgggtatgtgagtctttgtttgccgctctgtgagaaagtgagggcaataggggaagtatttcagaaagagggacagggattgtgctcatgagaacaggaagagaatgaatgt

SEQ ID NO: 279693 - DNA, 263 bp, Homo sapiens
gctgtgtgtgcccttgtctcacacgccgtgtgtgtccgcgcccttttgtggcgtggcagcttatgtgcgtgcagacagacgccctgtatgtgtgcctccctccacgacagcctccgtgcgcgcgcgcctgcgtgtgtggcaggacatggcctgtgcctttcagctctgtgagaggctatttctggatgctggctgcatccagatgttggctgccagggatctggggggcagccttgtggcttctggtcgacttgggatctgct

SEQ ID NO: 279694 - DNA, 1089 bp, Homo sapiens
acagagactctgaggaagcagtcacctcaggcctctccatcctagagacggcagaaggacaaacatctcctgctggcacaaggaagtcataactcatgtgagtggagccatgtgggattaagaagtgataggagagcttgctgtctgtctctgctctccactgtgtgaggatacaacaggaagacagccatctggtgaggaagagagggccctcgccagataccggacctgctgacaccttgatcttggacttcccatcttccaggaaggcctgacctcagttgttccagggtaaagaatttgggcagtgcccacacccacgctgttggataacatttcttcaccataccagtgagggtgaatgtgtacacgcccagcttcctgcctgttactctccacagtatgcgaagaatatccctgacttctagccctgtgcgccttcttttgtttctgctgttgctactaatagccttggagatcatggtgtacaacagtgacaacaacatggtcaaacctctgggcctcctggggaagaaggtaaatgccaccagcacttggggagaattgacccaaacgctgggagaagtggggcgagacctcaggatgctcctttgtgacatcaaaccccagataaagaccagtgatccttccactctgcaagtcgagatgttttgtcaacgtgaagcagaacggtgcactggtgcatcctggcagttcgccaccaatggagagaaatccctcctctttgacgcaatgaacatgacctggacagtaattaatcatgaagccagtaagatcaaggagacatggaagaaagacagagggctggaaaagtatttcaggaagctctcaaagggagactgcgatcactggctcagggaattcttagggcactgggaggcaatgccagaaccgacagtgtcaccagtaaatgcttcagatatccactggtcttcttctagtctaccagatagatggatcatcctgggggcattcatcctgttagttttaatgggaattgttctcatctgtgtctggtggcaaaatggtgagtggcaggctggtctctggcccttgaggacgtcttag

SEQ ID NO: 279695 - DNA, 1176 bp, Homo sapiens
acagagactctgaggaagcagtcacctcaggcctctccatcctagagacggcagaaggacaaacatctcctgctggcacaaggaagtcataactcatgtgagtggagccatgtgggattaagaagtgataggagagcttgctgtctgtctctgctctccactgtgtgaggatacaacaggaagacagccatctggtgaggaagagagggccctcgccagataccggacctgctgacaccttgatcttggacttcccatcttccaggaaggcctgacctcagttgttccagggtaaagaatttgggcagtgcccacacccacgctgttggataacatttcttcaccataccagtgagggtgaatgtgtacacgcccagcttcctgcctgttactctccacagtatgcgaagaatatccctgacttctagccctgtgcgccttcttttgtttctgctgttgctactaatagccttggagatcatggtggtggtcactctctttgcttcaacttcactataaaatcattgtccagacctggacagccctggtgtgaagcgcaggtcttcttgaataaaaatcttttccttcagtacaacagtgacaacaacatggtcaaacctctgggcctcctggggaagaaggtaaatgccaccagcacttggggagaattgacccaaacgctgggagaagtggggcgagacctcaggatgctcctttgtgacatcaaaccccagataaagaccagtgatccttccactctgcaagtcgagatgttttgtcaacgtgaagcagaacggtgcactggtgcatcctggcagttcgccaccaatggagagaaatccctcctctttgacgcaatgaacatgacctggacagtaattaatcatgaagccagtaagatcaaggagacatggaagaaagacagagggctggaaaagtatttcaggaagctctcaaagggagactgcgatcactggctcagggaattcttagggcactgggaggcaatgccagaaccgacagtgtcaccagtaaatgcttcagatatccactggtcttcttctagtctaccagatagatggatcatcctgggggcattcatcctgttagttttaatgggaattgttctcatctgtgtctggtggcaaaatggcagaagatccacctagaggtgat

SEQ ID NO: 279696 - DNA, 1005 bp, Homo sapiens
caatgtttgcgtgcaaatgctgccgcaaagcagtcccaataccccacctagaaagatgagccagtgatttgggagaccaagaggcaggaaaccatcccaccttctccaacccatcaccaaatctgttgctggaagacaccaagtaaatcccagggtcttaatgaggcaccatcaggccagccctgtggagtgatggggacatagctgggtttccctgagctactctattggggtgggagcagggggacagaagatggtgacagtggctcctctcacccctaggtctctgaaggtccagacagcactgatggcgagctttgggtccgcacactctggaaagaagagagaagtgaaggctctaggtagggagaacagagagccactgggcacaggcttctctcctcttgtttaaagaagcccagggagggatagagctctgactggacagaagactgtactctgcagcctgccttcctagagttgggttgtcactgtcctgcagggggcagcagccaccagcaaacaccactgcctgcaggagcctgggctgactggttgggactcaccgaagatcccttcttcctgggcggtggcctgcaggaactggaacagctgctctgtgtagcccaactctgcagaagagagaagacctagacctggcacccagcacagacacagcctgcctcgaggactgcaagggaacaagggcctcaccagtatcgggcagctggccctggcggaggaaggcggcagcctgtgcaaaggccttgagcagcgggctgagcaggcggcagaggaaaagaaagaaatctgggcagtgtgactgctggctgagctggaggggacaggccggggtgagtgcagctccccaccgcctccctaccacctccctccaggggcagctttttgaaacacaccctgaagtaccggccgtcagcctctccgaagtcatcactgtcactatcagtaaagtccccactcggtttccacaaaaaaaattctgct

SEQ ID NO: 279697 - DNA, 1027 bp, Homo sapiens
ggggaaagggaaacctttccatgtattccagtttgtaccttttacatggacatgagttacctaagggggagaggaaatcaacactggataaataaaagccctgctctgatagcaaaggacaatagtcagtgattttcacaatgactctgatggttgatagagctaggaaatagatttcagaaagcaaaacctttagctgctgcaggatctgcccagcctgcccgggattgcccacctgttcccagccagaccctctcacctgctctggtctctacagagccttggctgcccagttgccagtcctaccacggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggtcagtgcctccccactgccctccctagtcactgggcccatcacaagggcattctgagctcagtattgagcctactggagccacctctcgctcaatagtgcattcaacagaaactctacaggattatacacacagtagtaacactggccttggaaaaaaaaagttaatgtacgtgttttcctggttacaaaagcaatacaccttcactgtagataaaacagagataaacatttaaaaattatgtcacccataatcccactgcccatggctcagaatattaatgtttttctgtctaccttcctattgtttctccactcctgtatatgtttatactgtacatatacttaccttttacttaagactccatcaggagcattttttcatgccattaaatattctccctgacatatttaggttaccttggagttttgtgatgtacagggtagtttatattcctgagtaccttactgctggatacttgtttccagttttttgtttctataaataaatgtcgcaatgaacatccttatgta

SEQ ID NO: 279698 - DNA, 810 bp, Homo sapiens
acgtcaccggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccagagccttggctgcccagttgccagtcctaccacggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggtgacctcaatttggccaatgagggaccttcaagtttgttccatccccaagcttttagcatatatttgctttctggccaagacgttccaggctcatcatgtactgtctgtcttggaccaaggaacccggtgctccttactggggagtggtattagagaccaacatctggatgtcaggtgtacttataccaactctggttattattagaaagagccaccaattttaaaggccaaattatatctattttatagtgtattttatggattatgggagaggctgagcattttttcatgttttgtggccatgtccgttacctttttgtgaattgcttactcaagtcctttgtgggatctttctcttactaaagtgagttaatagattaaaacacttaaaatagtgcctgaca

SEQ ID NO: 279699 - DNA, 345 bp, Homo sapiens
acgtcaccggacgcgcccgcttctcgctggagtgcgcaccgagcggcagtgacttcgccgctgctgtagttccctggcggaggaaggcggcagcctgtgcaaaggccttgagcagcgggctgagcaggcggcagaggaaaagaaagaaatctgggcagtgtgactgctggctgagctggaggggacaggccggggtgagtgcagctccccaccgcctccctaccacctccctccaggggcagctttttgaaacacaccctgaagtaccggccgtcagcctctccgaagtcatcactgtcactatcagtaaagtccccactcggtttccacaaaaaaaattctgct

SEQ ID NO: 279700 - DNA, 1117 bp, Homo sapiens
acgtcaccggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccagatccacacaacttaaagatctgctgtcgagtgaatggggaagtggtccagagcagcaacaccaaccagatggtattcaagacagaggacctgatagcctgggtgtcccagtttgttaccttttacccaggggatgtcatcctgactgggacccccccacctccacccaggtgtcggtgtattcaggaaacctcctgtctttctcaaggtctctgaaggtccagacagcactgatggcgagctttgggtccgcacactctggaaagaagagagaagtgaaggctctaggtagggagaacagagagccactgggcacaggcttctctcctcttgtttaaagaagcccagggagggatagagctctgactggacagaagactgtactctgcagcctgccttcctagagttgggttgtcactgtcctgcagggggcagcagccaccagcaaacaccactgcctgcaggagcctgggctgactggttgggactcaccgaagatcccttcttcctgggcggtggcctgcaggaactggaacagctgctctgtgtagcccaactctgcagaagagagaagacctagacctggcacccagcacagacacagcctgcctcgaggactgcaagggaacaagggcctcaccagtatcgggcagctggccctggcggaggaaggcggcagcctgtgcaaaggccttgagcagcgggctgagcaggcggcagaggaaaagaaagaaatctgggcagtgtgactgctggctgagctggaggggacaggccggggtgagtgcagctccccaccgcctccctaccacctccctccaggggcagctttttgaaacacaccctgaagtaccggccgtcagcctctccgaagtcatcactgtcactatcagtaaagtccccactcggtttccacaaaaaaaattctgct

SEQ ID NO: 279701 - DNA, 1834 bp, Homo sapiens
acgtcaccggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccagagccttggctgcccagttgccagtcctaccacggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggtgaagtggaaaaggtgggctcccaggccagagtgcagcagagtccccagctcctgcctctcctagttctgacctcgctcaccaacacatggtgccagctgtccctgacactaggaagcagtcagcctccttgctccctgacactgcctttcccttcacccacctttggctggctctggctactaacatgggataacagctttgagatcccttgccacaggtgttggtgtcacccatgatctatcctcctgtatggccaaatcccctgcccccataggccacagatgccatggcccacgtggccggcttcactgtggctcatgacgtgagtgctcgtgactggctaacaagatgcaatgggaaacagtggctgctgggaaaaaccttcgacaccttctgccctctgggccctgccttggtgaccaaggacagtgtagcagatccacacaacttaaagatctgctgtcgagtgaatggggaagtggtccagagcagcaacaccaaccagatggtattcaagacagaggacctgatagcctgggtgtcccagtttgttaccttttacccaggggatgtcatcctgactgggacccccccacctccacccaggtgtcggtgtattcaggaaacctcctgtctttctcaaggtctctgaaggtccagacagcactgatggcgagctttgggtccgcacactctggaaagaagagagaagtgaaggctctaggtagggagaacagagagccactgggcacaggcttctctcctcttgtttaaagaagcccagggagggatagagctctgactggacagaagactgtactctgcagcctgccttcctagagttgggttgtcactgtcctgcagggggcagcagccaccagcaaacaccactgcctgcaggagcctgggctgactggttgggactcaccgaagatcccttcttcctgggcggtggcctgcaggaactggaacagctgctctgtgtagcccaactctgcagaagagagaagacctagacctggcacccagcacagacacagcctgcctcgaggactgcaagggaacaagggcctcaccagtatcgggcagctggccctggcggaggaaggcggcagcctgtgcaaaggccttgagcagcgggctgagcaggcggcagaggaaaagaaagaaatctgggcagtgtgactgctggctgagctggaggggacaggccggggtgagtgcagctccccaccgcctccctaccacctccctccaggggcagctttttgaaacacaccctgaagtaccggccgtcagcctctccgaagtcatcactgtcactatcagtaaagtccccactcggtttccacaaaaaaaattctgct

SEQ ID NO: 279702 - DNA, 1614 bp, Homo sapiens
acgtcaccggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccagagccttggctgcccagttgccagtcctaccacggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggtgttggtgtcacccatgatctatcctcctgtatggccaaatcccctgcccccataggccacagatgccatggcccacgtggccggcttcactgtggctcatgacgtgagtgctcgtgactggctaacaagatgcaatgggaaacagtggctgctgggaaaaaccttcgacaccttctgccctctgggccctgccttggtgaccaaggacagtgtagcagatccacacaacttaaagatctgctgtcgagtgaatggggaagtggtccagagcagcaacaccaaccagatggtattcaagacagaggacctgatagcctgggtgtcccagtttgttaccttttacccaggggatgtcatcctgactgggacccccccacctccacccaggtgtcggtgtattcaggaaacctcctgtctttctcaaggtctctgaaggtccagacagcactgatggcgagctttgggtccgcacactctggaaagaagagagaagtgaaggctctaggtagggagaacagagagccactgggcacaggcttctctcctcttgtttaaagaagcccagggagggatagagctctgactggacagaagactgtactctgcagcctgccttcctagagttgggttgtcactgtcctgcagggggcagcagccaccagcaaacaccactgcctgcaggagcctgggctgactggttgggactcaccgaagatcccttcttcctgggcggtggcctgcaggaactggaacagctgctctgtgtagcccaactctgcagaagagagaagacctagacctggcacccagcacagacacagcctgcctcgaggactgcaagggaacaagggcctcaccagtatcgggcagctggccctggcggaggaaggcggcagcctgtgcaaaggccttgagcagcgggctgagcaggcggcagaggaaaagaaagaaatctgggcagtgtgactgctggctgagctggaggggacaggccggggtgagtgcagctccccaccgcctccctaccacctccctccaggggcagctttttgaaacacaccctgaagtaccggccgtcagcctctccgaagtcatcactgtcactatcagtaaagtccccactcggtttccacaaaaaaaattctgct

SEQ ID NO: 279703 - DNA, 1250 bp, Homo sapiens
acgtcaccggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccaggaggtagattgggaagtggagctggccgtggtcattggaaagaaaggcaagcacatcaagtggctgctgggaaaaaccttcgacaccttctgccctctgggccctgccttggtgaccaaggacagtgtagcagatccacacaacttaaagatctgctgtcgagtgaatggggaagtggtccagagcagcaacaccaaccagatggtattcaagacagaggacctgatagcctgggtgtcccagtttgttaccttttacccaggggatgtcatcctgactgggacccccccacctccacccaggtgtcggtgtattcaggaaacctcctgtctttctcaaggtctctgaaggtccagacagcactgatggcgagctttgggtccgcacactctggaaagaagagagaagtgaaggctctaggtagggagaacagagagccactgggcacaggcttctctcctcttgtttaaagaagcccagggagggatagagctctgactggacagaagactgtactctgcagcctgccttcctagagttgggttgtcactgtcctgcagggggcagcagccaccagcaaacaccactgcctgcaggagcctgggctgactggttgggactcaccgaagatcccttcttcctgggcggtggcctgcaggaactggaacagctgctctgtgtagcccaactctgcagaagagagaagacctagacctggcacccagcacagacacagcctgcctcgaggactgcaagggaacaagggcctcaccagtatcgggcagctggccctggcggaggaaggcggcagcctgtgcaaaggccttgagcagcgggctgagcaggcggcagaggaaaagaaagaaatctgggcagtgtgactgctggctgagctggaggggacaggccggggtgagtgcagctccccaccgcctccctaccacctccctccaggggcagctttttgaaacacaccctgaagtaccggccgtcagcctctccgaagtcatcactgtcactatcagtaaagtccccactcggtttccacaaaaaaaattctgct

SEQ ID NO: 279704 - DNA, 977 bp, Homo sapiens
acgtcaccggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccagatccacacaacttaaagatctgctgtcgagtgaatggggaagtggtccagagcagcaacaccaaccagatggtattcaagacagaggacctgatagcctgggtgtcccagtttgttaccttttacccaggggatgtcatcctgactgggacccccccacctccacccaggtgtcggtgtattcaggaaacctcctgtctttctcaaggtctctgaaggtccagacagcactgatggcgagctttgggtccgcacactctggaaagaagagagaagtgaaggctctagggggcagcagccaccagcaaacaccactgcctgcaggagcctgggctgactggttgggactcaccgaagatcccttcttcctgggcggtggcctgcaggaactggaacagctgctctgtgtagcccaactctgcagaagagagaagacctagacctggcacccagcacagacacagcctgcctcgaggactgcaagggaacaagggcctcaccagtatcgggcagctggccctggcggaggaaggcggcagcctgtgcaaaggccttgagcagcgggctgagcaggcggcagaggaaaagaaagaaatctgggcagtgtgactgctggctgagctggaggggacaggccggggtgagtgcagctccccaccgcctccctaccacctccctccaggggcagctttttgaaacacaccctgaagtaccggccgtcagcctctccgaagtcatcactgtcactatcagtaaagtccccactcggtttccacaaaaaaaattctgct

SEQ ID NO: 279705 - DNA, 1395 bp, Homo sapiens
  misc_feature (1186)..(1186): n is a, c, g, or t
  misc_feature (1214)..(1214): n is a, c, g, or t
  misc_feature (1240)..(1240): n is a, c, g, or t
  misc_feature (1269)..(1269): n is a, c, g, or t
  misc_feature (1275)..(1275): n is a, c, g, or t
  misc_feature (1325)..(1325): n is a, c, g, or t
  misc_feature (1328)..(1328): n is a, c, g, or t
acgtcaccggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccaggtagaccaggcctggctgggttaggccagaagggtgtccctggcgcaggtctcccgcggagggcagaactagaaccaggttcccggccgtttccgaccacacggatggggcggacccatgtgagccctcactaattgcaggggacgaagctgggcatatggggaaactgggggtttccaggcgagtggacggtgggatgggatccgacgtgcacacccacgtttcaggctactgtttccacctcacgtcgccgcccctttgcttatggactcttgcagagttggattgagctcggactgtgtgacatagtggttgttgcagaagccccagggccactttctgactagtaccttgggcacctgacgtcatccctttgagtctcagtgtcctcttctgtaaagtgagggcgctttacctgaggggattgctgtaaggttggaatgaacctgcatgtgtgagtcatgtgggaagggaacagtcaatggggcctggggttctcttggagagctggtaaccagcctcgtccctgaggcaacagccagagggcgcctgtagtttccccacgcatggctgttagcagggcctctgcaggatctcctgtgggaggtccctacttctcactacaatctttagggcctttggaggatttcctatggaaggtccccacttctcaccacaacattctgggttaaaatgtccttggtaggaagatggggctgaagctagattttcttgcttgcattacaagcttctgaaccaaggacttcaatgtcacctggacttggattcacatcccagctccttcccttcctagctttaagactgtgtaaccttgggcaaatcccttaaccgctttaagccttaactgtttcatctgtaaaatgggactaacagtacctaccttccacaagcgtcaagaattaaatcaggcctggcgcggtggctcacgcctgtaataccaacaatttgggaggccgaggcaggcggatcacaaggtcnggagatcgagaccgtcctggctaacacngtgaaacaccgtctctactaaaaatncaaaaattagctgggcgtggcggcgtgcncctgtngtctcagctgctggggaggctgaggcaggagaatggcgtgaacccgggangcngagcttgcagtgagccaagatcgtgccactgcattccagcctgggcgacagagcgagactccatctc

SEQ ID NO: 279706 - DNA, 1815 bp, Homo sapiens
ggggaaagggaaacctttccatgtattccagtttgtaccttttacatggacatgagttacctaagggggagaggaaatcaacactggataaataaaagccctgctctgatagcaaaggacaatagtcagtgattttcacaatgactctgatggttgatagagctaggaaatagatttcagaaagcaaaacctttagctgctgcaggatctgcccagcctgcccgggattgcccacctgttcccagccagaccctctcacctgctctggtctctacagagccttggctgcccagttgccagtcctaccacggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggtgaagtggaaaaggtgggctcccaggccagagtgcagcagagtccccagctcctgcctctcctagttctgacctcgctcaccaacacatggtgccagctgtccctgacactaggaagcagtcagcctccttgctccctgacactgcctttcccttcacccacctttggctggctctggctactaacatgggataacagctttgagatcccttgccacaggtgttggtgtcacccatgatctatcctcctgtatggccaaatcccctgcccccataggccacagatgccatggcccacgtggccggcttcactgtggctcatgacgtgagtgctcgtgactggctaacaagatgcaatgggaaacagtggctgctgggaaaaaccttcgacaccttctgccctctgggccctgccttggtgaccaaggacagtgtagcagatccacacaacttaaagatctgctgtcgagtgaatggggaagtggtccagagcagcaacaccaaccagatggtattcaagacagaggacctgatagcctgggtgtcccagtttgttaccttttacccaggggatgtcatcctgactgggacccccccacctccacccaggtgtcggtgtattcaggaaacctcctgtctttctcaaggtctctgaaggtccagacagcactgatggcgagctttgggtccgcacactctggaaagaagagagaagtgaaggctctaggtagggagaacagagagccactgggcacaggcttctctcctcttgtttaaagaagcccagggagggatagagctctgactggacagaagactgtactctgcagcctgccttcctagagttgggttgtcactgtcctgcagggggcagcagccaccagcaaacaccactgcctgcaggagcctgggctgactggttgggactcaccgaagatcccttcttcctgggcggtggcctgcaggaactggaacagctgctctgtgtagcccaactctgcagaagagagaagacctagacctggcacccacgggctgagcaggcggcagaggaaaagaaagaaatctgggcagtgtgactgctggctgagctggaggggacaggccggggtgagtgcagctccccaccgcctccctaccacctccctccaggggcagctttttgaaacacaccctgaagtaccggccgtcagcctctccgaagtcatcactgtcactatcagtaaagtccccactcggtttccacaaaaaaaattctgct

SEQ ID NO: 279707 - DNA, 342 bp, Homo sapiens
tgctgtagacagatgccctttttcaaggcaaaaaccctagccatttttctcttctccttcagagtctgcaacatcctctcaactcatccaagtgactactgcctggtgctcttggggatgcagggaggcctgagaaggccaatgtctatacagaaagttctaacatagtgcactgagtcaatgtgggcactttaaagccctttcacctgccaagtcacgaagcacccctatagttgtgtttgtaaaatactggggggtttgaaggggaaaagggataactccaaggtaccatctttgcatttcagatccacacaacttaaagatctgctgtcgagtgaatgg

SEQ ID NO: 279708 - DNA, 1924 bp, Homo sapiens
ggggaaagggaaacctttccatgtattccagtttgtaccttttacatggacatgagttacctaagggggagaggaaatcaacactggataaataaaagccctgctctgatagcaaaggacaatagtcagtgattttcacaatgactctgatggttgatagagctaggaaatagatttcagaaagcaaaacctttagctgctgcaggatctgcccagcctgcccgggattgcccacctgttcccagccagaccctctcacctgctctggtctctacagagccttggctgcccagttgccagtcctaccacggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggtgaagtggaaaaggtgggctcccaggccagagtgcagcagagtccccagctcctgcctctcctagttctgacctcgctcaccaacacatggtgccagctgtccctgacactaggaagcagtcagcctccttgctccctgacactgcctttcccttcacccacctttggctggctctggctactaacatgggataacagctttgagatcccttgccacaggtgttggtgtcacccatgatctatcctcctgtatggccaaatcccctgcccccataggccacagatgccatggcccacgtggccggcttcactgtggctcatgacgtgagtgctcgtgactggctaacaagatgcaatgggaaacagtggctgctgggaaaaaccttcgacaccttctgccctctgggccctgccttggtgaccaaggacagtgtagcagatccacacaacttaaagatctgctgtcgagtgaatggggaagtggtccagagcagcaacaccaaccagatggtattcaagacagaggacctgatagcctgggtgtcccagtttgttaccttttacccaggggatgtcatcctgactgggacccccccacctccacccaggtgtcggtgtattcaggaaacctcctgtctttctcaaggtctctgaaggtccagacagcactgatggcgagctttgggtccgcacactctggaaagaagagagaagtgaaggctctaggtagggagaacagagagccactgggcacaggcttctctcctcttgtttaaagaagcccagggagggatagagctctgactggacagaagactgtactctgcagcctgccttcctagagttgggttgtcactgtcctgcagggggcagcagccaccagcaaacaccactgcctgcaggagcctgggctgactggttgggactcaccgaagatcccttcttcctgggcggtggcctgcaggaactggaacagctgctctgtgtagcccaactctgcagaagagagaagacctagacctggcacccagcacagacacagcctgcctcgaggactgcaagggaacaagggcctcaccagtatcgggcagctggccctggcggaggaaggcggcagcctgtgcaaaggccttgagcagcgggctgagcaggcggcagaggaaaagaaagaaatctgggcagtgtgactgctggctgagctggaggggacaggccggggtgagtgcagctccccaccgcctccctaccacctccctccaggggcagctttttgaaacacaccctgaagtaccggccgtcagcctctccgaagtcatcactgtcactatcagtaaagtccccactcggtttccacaaaaaaaattctgct

SEQ ID NO: 279709 - DNA, 1686 bp, Homo sapiens
ggggaaagggaaacctttccatgtattccagtttgtaccttttacatggacatgagttacctaagggggagaggaaatcaacactggataaataaaagccctgctctgatagcaaaggacaatagtcagtgattttcacaatgactctgatggttgatagagctaggaaatagatttcagaaagcaaaacctttagctgctgcaggatctgcccagcctgcccgggattgcccacctgttcccagccagaccctctcacctgctctggtctctacagagccttggctgcccagttgccagtcctaccacggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggtgaagtggaaaaggtgggctcccaggccagagtgcagcagagtccccagctcctgcctctcctagttctgacctcgctcaccaacacatggtgccagctgtccctgacactaggaagcagtcagcctccttgctccctgacactgcctttcccttcacccacctttggctggctctggctactaacatgggataacagctttgagatcccttgccacaggtgttggtgtcacccatgatctatcctcctgtatggccaaatcccctgcccccataggccacagatgccatggcccacgtggccggcttcactgtggctcatgacgtgagtgctcgtgactggctaacaagatgcaatgggaaacagtggctgctgggaaaaaccttcgacaccttctgccctctgggccctgccttggtgaccaaggacagtgtagcagatccacacaacttaaagatctgctgtcgagtgaatggggaagtggtccagagcagcaacaccaaccagatggtattcaagacagaggacctgatagcctgggtgtcccagtttgttaccttttacccaggggatgtcatcctgactgggacccccccacctccacccaggtgtcggtgtattcaggaaacctcctgtctttctcaaggtctctgaaggtccagacagcactgatggcgagctttgggtccgcacactctggaaagaagagagaagtgaaggctctaggaactggaacagctgctctgtgtagcccaactctgcagaagagagaagacctagacctggcacccagcacagacacagcctgcctcgaggactgcaagggaacaagggcctcaccagtatcgggcagctggccctggcggaggaaggcggcagcctgtgcaaaggccttgagcagcgggctgagcaggcggcagaggaaaagaaagaaatctgggcagtgtgactgctggctgagctggaggggacaggccggggtgagtgcagctccccaccgcctccctaccacctccctccaggggcagctttttgaaacacaccctgaagtaccggccgtcagcctctccgaagtcatcactgtcactatcagtaaagtccccactcggtttccacaaaaaaaattctgct

SEQ ID NO: 279710 - DNA, 2503 bp, Homo sapiens
acttctggggcagccgtgagcagcgggcacacgggcagccacgaaagcagcagcgagggtggtgcaaacacctcataactacaccgaatccagtagcgcctggcgcccccggcgcgcaaggccgcctctactccgcctcatctttgtcccaagtcctttcacagcctgccttcctcaaacggcccgatgcgcccccgtctttgccggagtaagcagaccgccagcagccggcccgcaggtcagtcgaccctctctggatgcaggtcgccgggaaaacccggagcggagcatccctcgggccgggaaacgccctcggcgcgcacccactggcgcgcatgctcagtccgcgcggcggctgcgagtaggaagctccgcgcggcggcgggggcggcgacggcgactggcgggtgggagtggaggcaccggctggcgggcgggggtacagggacggggcaggggctcccgctccaggttccttgaagcacttccgaccgcgaagcccggcgcgagaagcgagctaacccaagagccaacaacgagcgcggagagggcagcggactgagcggagccgccggccagagcgggctcggagcccgggtctccgccgctcgggacccggctaggcggcggcgggggcggcgatgttccactgcatccccctgtggcggtgcaaccgtcatgtggagagcatcgacaagcgccactgctcgctggtctacgtccccgaggagatctaccgctatgcccggagcctggaggagctgctgctggacgccaaccagctccgcgagctgcccgagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaatctttataacctggcttcactggaactgagagagaatcttcttacatatcttcctgactctcttacccagctgcgaagactagaagaacttgatttaggaaacaatgaaatatataatttgccagaatcaattggagccctcttacatctaaaagatctctggttggatggaaatcaactgtcagaattacctcaggaaataggaaatctgaagaacctgctgtgtttagatgtctctgaaaacaggttggaaagacttcctgaagaaatcagtggcctgacttcattaacggatttagtcatttcccagaacttattagaaacgattccggatggcattggaaaactaaagaaactgtcaatcttgaaggtggatcagaatagactcacacagttgcctgaagcagttggggaatgtgaaagtctcactgagttagttcttacagaaaatcagctcctgaccctgcctaaaagcattggaaaactaaagaagttgagcaacttgaatgcagacagaaataaattagtgtccttaccaaaagaggtatgtgcttttagagaaatcacatgataataattatgaagaaataataataatacataagggatcaaaaatgtcaaatgctttgaaaagacgcatgtgttgttttttaaaggtgtgaactctaaatctgtgagtatagagccaactggaggaattatgtcaaagaatgatcatcagtaacattaaggagagttggaaaaggtgaatttataggattttaaatgggagaaagaaagagattgacattttgggtttgatatacagagaatggtgacaccattggcagaaattgataatttgggagtttgacagaggaagtggatgcctttgggtttgatttttgaatttaatgtgaaattaagctccatcccataagcaattggaattataaaaattgatcttgatgcaaccatatttctgggcagagatttacattgggccatgctcatgtcttggatgaggttgaacaaactgttcacaaaggcatacacatagaggaaggtgaatgggaagctaaagccagcttcctaggactttttttttggttagtagtctaagcacgagaaaatgagacatcaccatctgttgtggagagtagctgtatggactgagaggcatttaaattctggcaagggaggtggaaatgctgacaatgaggaggaagcttatagtgggtcaaacaaggaggtgtctagtgtgttgtttaaaaagaaggcttacaattagccaggcgtggtggcgggcgcctgtagtcccagctactcgggaggctgaggcaagagaattgcctgaacccgggaggctaaggttgcagtgagccgagaccacgccactgcactccagcccgggtgacagagcgagactctatctca

SEQ ID NO: 279711 - DNA, 2476 bp, Homo sapiens
acttctggggcagccgtgagcagcgggcacacgggcagccacgaaagcagcagcgagggtggtgcaaacacctcataactacaccgaatccagtagcgcctggcgcccccggcgcgcaaggccgcctctactccgcctcatctttgtcccaagtcctttcacagcctgccttcctcaaacggcccgatgcgcccccgtctttgccggagtaagcagaccgccagcagccggcccgcaggtcagtcgaccctctctggatgcaggtcgccgggaaaacccggagcggagcatccctcgggccgggaaacgccctcggcgcgcacccactggcgcgcatgctcagtccgcgcggcggctgcgagtaggaagctccgcgcggcggcgggggcggcgacggcgactggcgggtgggagtggaggcaccggctggcgggcgggggtacagggacggggcaggggctcccgctccaggttccttgaagcacttccgaccgcgaagcccggcgcgagaagcgagctaacccaagagccaacaacgagcgcggagagggcagcggactgagcggagccgccggccagagcgggctcggagcccgggtctccgccgctcgggacccggctaggcggcggcgggggcggcgatgttccactgcatccccctgtggcggtgcaaccgtcatgtggagagcatcgacaagcgccactgctcgctggtctacgtccccgaggagatctaccgctatgcccggagcctggaggagctgctgctggacgccaaccagctccgcgagctgcccgagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaatctttataacctggcttcactggaactgagagagaatcttcttacatatcttcctgactctcttacccagctgcgaagactagaagaacttgatttaggaaacaatgaaatatataatttgccagaatcaattggagccctcttacatctaaaagatctctggttggatggaaatcaactgtcagaattacctcaggaaataggaaatctgaagaacctgctgtgtttagatgtctctgaaaacaggttggaaagacttcctgaagaaatcagtggcctgacttcattaacggatttagtcatttcccagaacttattagaaacgattccggatggcattggaaaactaaagaaactgtcaatcttgaaggtggatcagaatagactcacacagttgcctgaagcagttggggaatgtgaaagtctcactgagttagttcttacagaaaatcagctcctgaccctgcctaaaagcattggaaaactaaagaagttgagcaacttgaatgcagacagaaataaattagtgtccttaccaaaagagatcggcgggtgctgcagcctcactgtgttctgtgtacgtgacaacagactaactcggatacctgcagaggtgtcacaggcaacagaacttcatgtcctggatgtggcagggaacaggttgctgcatctacctttatccctgactgccttgaagttgaaggctctgtggctatctgacaaccagtcccagcccctgcttacattccagacagacacagactacaccacaggagagaagattttaacctgtgtcttacttcctcagctgccttctgaacctacttgtcaagagaatctgcctcgctgtggtgcactggagaacttggtaaatgatgtctctgatgaagcctggaacgagcgtgctgtcaacagagtcagtgcgatccgatttgtggaggatgagaaagatgaagaagacaatgagacgagaacacttctaaggcgagccactccacacccaggggagttaaagcacatgaaaaagacagtggagaatttacggaatgacatgaatgctgctaaaggactggactcaaacaaaaacgaggtcaatcatgccattgaccgagtgaccacttctgtgtagagtttcacctccaagttttacctcctgtgtcttcctctgctgtcgagacgttcctgtctgcttcccgggagcctcacgtgctccttgtcctaaccagcccccgcgcgccatcttcccgtggagtgtggggaagctgctgtctcccaggaagtgccttactcatcccgcaaccagtcagcgcaccagtggtctcccggtgtgattttttttttttttaatttcagttgtttgtaataagtagaatacactactgtaaacat

SEQ ID NO: 279712 - DNA, 3338 bp, Homo sapiens
gctaggtactgacacctggcacttgtgcccggtcagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaatctttataacctggcttcactggaactgagagagaatcttcttacatatcttcctgactctcttacccagctgcgaagactagaagaacttgatttaggaaacaatgaaatatataatttgccagaatcaattggagccctcttacatctaaaagatctctggttggatggaaatcaactgtcagaattacctcaggaaataggaaatctgaagaacctgctgtgtttagatgtctctgaaaacaggttggaaagacttcctgaagaaatcagtggcctgacttcattaacggatttagtcatttcccagaacttattagaaacgattccggatggcattggaaaactaaagaaactgtcaatcttgaaggtggatcagaatagactcacacagttgcctgaagcagttggggaatgtgaaagtctcactgagttagttcttacagaaaatcagctcctgaccctgcctaaaagcattggaaaactaaagaagttgagcaacttgaatgcagacagaaataaattagtgtccttaccaaaagagatcggcgggtgctgcagcctcactgtgttctgtgtacgtgacaacagactaactcggatacctgcagaggtgtcacaggcaacagaacttcatgtcctggatgtggcagggaacaggttgctgcatctacctttatccctgactgccttgaagttgaaggctctgtggctatctgacaaccagtcccagcccctgcttacattccagacagacacagactacaccacaggagagaagattttaacctgtgtcttacttcctcagctgccttctgaacctacttgtcaagagaatctgcctcgctgtggtgcactggagaacttggtaaatgatgtctctgatgaagcctggaacgagcgtgctgtcaacagagtcagtgcgatccgatttgtggaggatgagaaagatgaagaagacaatgagacgagaacacttctaaggcgagccactccacacccaggggagttaaagcacatgaaaaagacagtggagaatttacggaatgacatgaatgctgctaaaggactggactcaaacaaaaacgaggtcaatcatgccattgaccgagtgaccacttctgtgtagagtttcacctccaagttttacctcctgtgtcttcctctgctgtcgagacgttcctgtctgcttcccgggagcctcacgtgctccttgtcctaaccagcccccgcgcgccatcttcccgtggagtgtggggaagctgctgtctcccaggaagtgccttactcatcccgcaaccagtcagcgcaccagtggtctcccggtgtgattttttttttttttaatttcagttgtttgtaataagtagaatacactactgtaaacatacgacctttgtttttgtcttatgttggggtaaaggaaagcaggaaggggaatttttatcctcctcccttccgtaaagtgctgggatattttgaatcccccaagttcccttggacctactgatgagagatagttttatgtatggggaaaaatggatactttttaaaccttttttggcagctcagatggtgtaaattttaaaattttgtataggtatttcataacaaaaatatgtatttcttttttgttattttatcttgaaaacggtacatattttagtatttgtgcagaaaaacaagtcctaaagtatttgtttttatttgtaccatccacttgtgccttactgtatcctgtgtcatgtccaatcagttgtaaacaatggcatctttgaacagtgtgatgagaataggaatgtggtgttttaaagcagtgttgcattttaatcagtaatctacctggtggatttgtttttaaccaaaaagatgaattatcaatgatttgtaattatatcggttgattttttttgaaaagatgaaccaaaggatttgactgctaatattttattccttacactttttttctgaataagtctctcataatgagtgcagtgtcagactgtgcctactctgatggtatgtgccatttgtaaaataaaatagagcagaaaaacacaaaaagagaacactggttcagacattcagtgggcaagtaaattatggactgcaaaataatgatttttattcaagaaagctttaaaagttttatatccagatatacaaccacaataaagcaaaataacctactatcaaaatagaaatgttgctatctttataagtgcaatttaatttgtaaatagagtttgaatcaaagtatcacaaaatactgcttcaagatttaattttaaatctgctaatttaagggatattgggaaaagttttggtgtgtttctgttgatttcttttttgtatgctgtgataaaagagaaatgaaaagtgccagtcactgtgtggtgtctaggaaaatcatatatatttttttctccaagaaataaattcatcctggacattggcatacagctttttaaaattattactttgtatgttcaagtgatagcaggtagccaaattctttgacagtgtgctctggtctgttaaatatctaaattacccgtcagttgtgagtgacctcctgtgggacttgcattcacatggggcagagcccagaattgcctttgactctggctagtaattttgggttgtggctatctggcccaattggactccttataaacccgtcttcaaccaaccaaatacaatacttttttttacttctatacatttacttattgggttcacttagctttttagtctgtgtgtatgtaaatatgtgtgtattttaaaaactatttatggagctgaaagtacataacacataagtgagtttcggctggtcagttttataccttgttccctaatctgtgcataccaattttcttttctctgttttaagatttttgacatcctctattttgttttaagcttataaagataatgccactatctcatgggctgattatatataagcaaattggttttatttaatgagaattgtcttgacgtggaagaaca

SEQ ID NO: 279713 - DNA, 2583 bp, Homo sapiens
ggacgcgtgggtcggacgcgtgggtcgcggacgcgtgggtcgacccacgcgtccgaagaagttgagcaacttgaatgcagacagaaataaattagtgtccttaccaaaagagatcggcgggtgctgcagcctcactgtgttctgtgtacgtgacaacagactaactcggatacctgcagaggtgtcacaggcaacagaacttcatgtcctggatgtggcagggaacaggttgctgcatctacctttatccctgactgccttgaagttgaaggctctgtggctatctgacaaccagtcccagcccctgcttacattccagacagacacagactacaccacaggagagaagattttaacctgtgtcttacttcctcagctgccttctgaacctacttgtcaagagaatctgcctcgctgtggtgcactggagaacttggtaaatgatgtctctgatgaagcctggaacgagcgtgctgtcaacagagtcagtgcgatccgatttgtggaggatgagaaagatgaagaagacaatgagacgagaacacttctaaggcgagccactccacacccaggggagttaaagcacatgaaaaagacagtggagaatttacggaatgacatgaatgctgctaaaggactggactcaaacaaaaacgaggtcaatcatgccattgaccgagtgaccacttctgtgtagagtttcacctccaagttttacctcctgtgtcttcctctgctgtcgagacgttcctgtctgcttcccgggagcctcacgtgctccttgtcctaaccagcccccgcgcgccatcttcccgtggagtgtggggaagctgctgtctcccaggaagtgccttactcatcccgcaaccagtcagcgcaccagtggtctcccggtgtgattttttttttttttaatttcagttgtttgtaataagtagaatacactactgtaaacatacgacctttgtttttgtcttatgttggggtaaaggaaagcaggaaggggaatttttatcctcctcccttccgtaaagtgctgggatattttgaatcccccaagttcccttggacctactgatgagagatagttttatgtatggggaaaaatggatactttttaaaccttttttggcagctcagatggtgtaaattttaaaattttgtataggtatttcataacaaaaatatgtatttcttttttgttattttatcttgaaaacggtacatattttagtatttgtgcagaaaaacaagtcctaaagtatttgtttttatttgtaccatccacttgtgccttactgtatcctgtgtcatgtccaatcagttgtaaacaatggcatctttgaacagtgtgatgagaataggaatgtggtgttttaaagcagtgttgcattttaatcagtaatctacctggtggatttgtttttaaccaaaaagatgaattatcaatgatttgtaattatatcggttgattttttttgaaaagatgaaccaaaggatttgactgctaatattttattccttacactttttttctgaataagtctctcataatgagtgcagtgtcagactgtgcctactctgatggtatgtgccatttgtaaaataaaatagagcagaaaaacacaaaaagagaacactggttcagacattcagtgggcaagtaaattatggactgcaaaataatgatttttattcaagaaagctttaaaagttttatatccagatatacaaccacaataaagcaaaataacctactatcaaaatagaaatgttgctatctttataagtgcaatttaatttgtaaatagagtttgaatcaaagtatcacaaaatactgcttcaagatttaattttaaatctgctaatttaagggatattgggaaaagttttggtgtgtttctgttgatttcttttttgtatgctgtgataaaagagaaatgaaaagtgccagtcactgtgtggtgtctaggaaaatcatatatatttttttctccaagaaataaattcatcctggacattggcatacagctttttaaaattattactttgtatgttcaagtgatagcaggtagccaaattctttgacagtgtgctctggtctgttaaatatctaaattacccgtcagttgtgagtgacctcctgtgggacttgcattcacatggggcagagcccagaattgcctttgactctggctagtaattttgggttgtggctatctggcccaattggactccttataaacccgtcttcaaccaaccaaatacaatacttttttttacttctatacatttacttattgggttcacttagctttttagtctgtgtgtatgtaaatatgtgtgtattttaaaaactatttatggagctgaaagtacataacacataagtgagtttcggctggtcagttttataccttgttccctaatctgtgcataccaattttcttttctctgttttaagatttttgacatcctctattttgttttaagcttataaagataatgccactatctcatgggctgattatatataagcaaattggttttatttaatgagaattgtcttgacgtggaagaaca

SEQ ID NO: 279714 - DNA, 2602 bp, Homo sapiens
tgctctgtaatctggaggttctaatgggagaagtgagagcagaaaagggaagcacaggaacctactgaggaatccacttgcaaagagtatgttgcgtcttaaaaacataacaccgtttttacattttgaaaccaatctcaggaagctccttttaatttttcctcattttgttgatagggattgatttgattacaaaatttgaggttgtgatgtctcttttttttaaaaaaaaaaaaaaaaaaaacaggttgctgcatctacctttatccctgactgccttgaagttgaaggctctgtggctatctgacaaccagtcccagcccctgcttacattccagacagacacagactacaccacaggagagaagattttaacctgtgtcttacttcctcagctgccttctgaacctacttgtcaagagaatctgcctcgctgtggtgcactggagaacttggtaaatgatgtctctgatgaagcctggaacgagcgtgctgtcaacagagtcagtgcgatccgatttgtggaggatgagaaagatgaagaagacaatgagacgagaacacttctaaggcgagccactccacacccaggggagttaaagcacatgaaaaagacagtggagaatttacggaatgacatgaatgctgctaaaggactggactcaaacaaaaacgaggtcaatcatgccattgaccgagtgaccacttctgtgtagagtttcacctccaagttttacctcctgtgtcttcctctgctgtcgagacgttcctgtctgcttcccgggagcctcacgtgctccttgtcctaaccagcccccgcgcgccatcttcccgtggagtgtggggaagctgctgtctcccaggaagtgccttactcatcccgcaaccagtcagcgcaccagtggtctcccggtgtgattttttttttttttaatttcagttgtttgtaataagtagaatacactactgtaaacatacgacctttgtttttgtcttatgttggggtaaaggaaagcaggaaggggaatttttatcctcctcccttccgtaaagtgctgggatattttgaatcccccaagttcccttggacctactgatgagagatagttttatgtatggggaaaaatggatactttttaaaccttttttggcagctcagatggtgtaaattttaaaattttgtataggtatttcataacaaaaatatgtatttcttttttgttattttatcttgaaaacggtacatattttagtatttgtgcagaaaaacaagtcctaaagtatttgtttttatttgtaccatccacttgtgccttactgtatcctgtgtcatgtccaatcagttgtaaacaatggcatctttgaacagtgtgatgagaataggaatgtggtgttttaaagcagtgttgcattttaatcagtaatctacctggtggatttgtttttaaccaaaaagatgaattatcaatgatttgtaattatatcggttgattttttttgaaaagatgaaccaaaggatttgactgctaatattttattccttacactttttttctgaataagtctctcataatgagtgcagtgtcagactgtgcctactctgatggtatgtgccatttgtaaaataaaatagagcagaaaaacacaaaaagagaacactggttcagacattcagtgggcaagtaaattatggactgcaaaataatgatttttattcaagaaagctttaaaagttttatatccagatatacaaccacaataaagcaaaataacctactatcaaaatagaaatgttgctatctttataagtgcaatttaatttgtaaatagagtttgaatcaaagtatcacaaaatactgcttcaagatttaattttaaatctgctaatttaagggatattgggaaaagttttggtgtgtttctgttgatttcttttttgtatgctgtgataaaagagaaatgaaaagtgccagtcactgtgtggtgtctaggaaaatcatatatatttttttctccaagaaataaattcatcctggacattggcatacagctttttaaaattattactttgtatgttcaagtgatagcaggtagccaaattctttgacagtgtgctctggtctgttaaatatctaaattacccgtcagttgtgagtgacctcctgtgggacttgcattcacatggggcagagcccagaattgcctttgactctggctagtaattttgggttgtggctatctggcccaattggactccttataaacccgtcttcaaccaaccaaatacaatacttttttttacttctatacatttacttattgggttcacttagctttttagtctgtgtgtatgtaaatatgtgtgtattttaaaaactatttatggagctgaaagtacataacacataagtgagtttcggctggtcagttttataccttgttccctaatctgtgcataccaattttcttttctctgttttaagatttttgacatcctctattttgttttaagcttataaagataatgccactatctcatgggctgattatatataagcaaattggttttatttaatgagaattgtcttgacgtggaagaaca

SEQ ID NO: 279715 - DNA, 2677 bp, Homo sapiens
taacattttgcagagatttttatgaacatatggggctgcgttttgtaagatttaaattaatgattgttggtcatcagtgagaccggtgagttatgtggtataagtttatgcatcctttttatactgtttggtaaacaaggtactctgatcctactccatctcccctagaaaactggaaaaaagatgtattttctttctcaccatagatcggcgggtgctgcagcctcactgtgttctgtgtacgtgacaacagactaactcggatacctgcagaggtgtcacaggcaacagaacttcatgtcctggatgtggcagggaacaggttgctgcatctacctttatccctgactgccttgaagttgaaggctctgtggctatctgacaaccagtcccagcccctgcttacattccagacagacacagactacaccacaggagagaagattttaacctgtgtcttacttcctcagctgccttctgaacctacttgtcaagagaatctgcctcgctgtggtgcactggagaacttggtaaatgatgtctctgatgaagcctggaacgagcgtgctgtcaacagagtcagtgcgatccgatttgtggaggatgagaaagatgaagaagacaatgagacgagaacacttctaaggcgagccactccacacccaggggagttaaagcacatgaaaaagacagtggagaatttacggaatgacatgaatgctgctaaaggactggactcaaacaaaaacgaggtcaatcatgccattgaccgagtgaccacttctgtgtagagtttcacctccaagttttacctcctgtgtcttcctctgctgtcgagacgttcctgtctgcttcccgggagcctcacgtgctccttgtcctaaccagcccccgcgcgccatcttcccgtggagtgtggggaagctgctgtctcccaggaagtgccttactcatcccgcaaccagtcagcgcaccagtggtctcccggtgtgattttttttttttttaatttcagttgtttgtaataagtagaatacactactgtaaacatacgacctttgtttttgtcttatgttggggtaaaggaaagcaggaaggggaatttttatcctcctcccttccgtaaagtgctgggatattttgaatcccccaagttcccttggacctactgatgagagatagttttatgtatggggaaaaatggatactttttaaaccttttttggcagctcagatggtgtaaattttaaaattttgtataggtatttcataacaaaaatatgtatttcttttttgttattttatcttgaaaacggtacatattttagtatttgtgcagaaaaacaagtcctaaagtatttgtttttatttgtaccatccacttgtgccttactgtatcctgtgtcatgtccaatcagttgtaaacaatggcatctttgaacagtgtgatgagaataggaatgtggtgttttaaagcagtgttgcattttaatcagtaatctacctggtggatttgtttttaaccaaaaagatgaattatcaatgatttgtaattatatcggttgattttttttgaaaagatgaaccaaaggatttgactgctaatattttattccttacactttttttctgaataagtctctcataatgagtgcagtgtcagactgtgcctactctgatggtatgtgccatttgtaaaataaaatagagcagaaaaacacaaaaagagaacactggttcagacattcagtgggcaagtaaattatggactgcaaaataatgatttttattcaagaaagctttaaaagttttatatccagatatacaaccacaataaagcaaaataacctactatcaaaatagaaatgttgctatctttataagtgcaatttaatttgtaaatagagtttgaatcaaagtatcacaaaatactgcttcaagatttaattttaaatctgctaatttaagggatattgggaaaagttttggtgtgtttctgttgatttcttttttgtatgctgtgataaaagagaaatgaaaagtgccagtcactgtgtggtgtctaggaaaatcatatatatttttttctccaagaaataaattcatcctggacattggcatacagctttttaaaattattactttgtatgttcaagtgatagcaggtagccaaattctttgacagtgtgctctggtctgttaaatatctaaattacccgtcagttgtgagtgacctcctgtgggacttgcattcacatggggcagagcccagaattgcctttgactctggctagtaattttgggttgtggctatctggcccaattggactccttataaacccgtcttcaaccaaccaaatacaatacttttttttacttctatacatttacttattgggttcacttagctttttagtctgtgtgtatgtaaatatgtgtgtattttaaaaactatttatggagctgaaagtacataacacataagtgagtttcggctggtcagttttataccttgttccctaatctgtgcataccaattttcttttctctgttttaagatttttgacatcctctattttgttttaagcttataaagataatgccactatctcatgggctgattatatataagcaaattggttttatttaatgagaattgtcttgacgtggaagaaca

SEQ ID NO: 279716 - DNA, 2128 bp, Homo sapiens
acttctggggcagccgtgagcagcgggcacacgggcagccacgaaagcagcagcgagggtggtgcaaacacctcataactacaccgaatccagtagcgcctggcgcccccggcgcgcaaggccgcctctactccgcctcatctttgtcccaagtcctttcacagcctgccttcctcaaacggcccgatgcgcccccgtctttgccggagtaagcagaccgccagcagccggcccgcaggtcagtcgaccctctctggatgcaggtcgccgggaaaacccggagcggagcatccctcgggccgggaaacgccctcggcgcgcacccactggcgcgcatgctcagtccgcgcggcggctgcgagtaggaagctccgcgcggcggcgggggcggcgacggcgactggcgggtgggagtggaggcaccggctggcgggcgggggtacagggacggggcaggggctcccgctccaggttccttgaagcacttccgaccgcgaagcccggcgcgagaagcgagctaacccaagagccaacaacgagcgcggagagggcagcggactgagcggagccgccggccagagcgggctcggagcccgggtctccgccgctcgggacccggctaggcggcggcgggggcggcgatgttccactgcatccccctgtggcggtgcaaccgtcatgtggagagcatcgacaagcgccactgctcgctggtctacgtccccgaggagatctaccgctatgcccggagcctggaggagctgctgctggacgccaaccagctccgcgagctgcccgagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaagcagaagacaactagctgacacctgttcagccagcaagttggtgtttttctgaaatgtacactgatgttttatctttatgccattagacttgctaattaaaaattctgcccttaaactctcaggaggagaagaagacaggaagccctcaatacactctaggtgtatggtatcagttgcagagaaaacagtggtattttattgtgaatttcatgcatgtacaattcacttttgctgtatcaagtgtcagatatttataatgtaacaatttttgtgctgggcatggtggctcacacctgtaatgccagccttttgggaggctgaggtgggaggattccttgagcccaggagttcaagaccagcctgggcaacatgacgataacccatctctacaaaaacaaaaaaaaaattagctgggcctggtggcccaaacctgtagtcccagctacttggaaggttgaggaggaaggatcacttgagcccagaaggttgaggctgcagtgagccatgattgtgccactgaattccagcctgggtgacagagcaagaccccatccccgctttgccccccctacacaaaaaaatcttaaatatagtagctgtttaaacacccaaactaacactgtcctcctcttgctcctcaggatgtctggagtttaattcccttattactctcccttccattcattcttagtctgcagctgcctagatggttctcctttctagcctctgattcctacccctctccttttttcccattttgtgtctttttaaaaagtcttaatgctttgagataaaatatattattaaaccagagtgtccctctcaccctctactgtactattttaatggaaagtattattttagaatacattttttataatgttcattattatatattttctgttaatatctgtacctgcttttgtcagtgttcaagatttttttgttttgttttgtttgtggacttaatcagcttctgttactattatagcattgtggatactgattgtttactgaataaaatgccactttgatcttga

SEQ ID NO: 279717 - DNA, 3281 bp, Homo sapiens
acttctggggcagccgtgagcagcgggcacacgggcagccacgaaagcagcagcgagggtggtgcaaacacctcataactacaccgaatccagtagcgcctggcgcccccggcgcgcaaggccgcctctactccgcctcatctttgtcccaagtcctttcacagcctgccttcctcaaacggcccgatgcgcccccgtctttgccggagtaagcagaccgccagcagccggcccgcaggtcagtcgaccctctctggatgcaggtcgccgggaaaacccggagcggagcatccctcgggccgggaaacgccctcggcgcgcacccactggcgcgcatgctcagtccgcgcggcggctgcgagtaggaagctccgcgcggcggcgggggcggcgacggcgactggcgggtgggagtggaggcaccggctggcgggcgggggtacagggacggggcaggggctcccgctccaggttccttgaagcacttccgaccgcgaagcccggcgcgagaagcgagctaacccaagagccaacaacgagcgcggagagggcagcggactgagcggagccgccggccagagcgggctcggagcccgggtctccgccgctcgggacccggctaggcggcggcgggggcggcgatgttccactgcatccccctgtggcggtgcaaccgtcatgtggagagcatcgacaagcgccactgctcgctggtctacgtccccgaggagatctaccgctatgcccggagcctggaggagctgctgctggacgccaaccagctccgcgagctgcccgagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaatctttataacctggcttcactggaactgagagagaatcttcttacatatcttcctgactctcttacccagctgcgaagactagaagaacttgatttaggaaacaatgaaatatataatttgccagaatcaattggagccctcttacatctaaaagatctctggttggatggaaatcaactgtcagaattacctcaggaaataggaaatctgaagaacctgctgtgtttagatgtctctgaaaacaggttggaaagacttcctgaagaaatcagtggcctgacttcattaacggatttagtcatttcccagaacttattagaaacgattccggatggcattggaaaactaaagaaactgtcaatcttgaaggtggatcagaatagactcacacagttgcctgaagcagttggggaatgtgaaagtctcactgagttagttcttacagaaaatcagctcctgaccctgcctaaaagcattggaaaactaaagaagttgagcaacttgaatgcagacagaaataaattagtgtccttaccaaaagagatcggcgggtgctgcagcctcactgtgttctgtgtacgtgacaacagactaactcggatacctgcagaggtgtcacaggcaacagaacttcatgtcctggatgtggcagggaacaggttgctgcatctacctttatccctgactgccttgaagttgaaggctctgtggctatctgacaaccagtcccagcccctgcttacattccagacagacacagactacaccacaggagagaagattttaacctgtgtcttacttcctcagctgccttctgaacctacttgtcaagagaatctgcctcgctgtggtgcactggagaacttggtaaatgatgtctctgatgaagcctggaacgagcgtgctgtcaacagagtcagtgcgatccgatttgtggaggatgagaaagatgaagaagacaatgagacgagaacacttctaaggcgagccactccacacccaggggagttaaagcacatgaaaaagacagtggagaatttacggaatgacatgaatgctgctaaaggactggactcaaacaaaaacgaggtcaatcatgccattgaccgagtgaccacttctgtgtagagtttcacctccaagttttacctcctgtgtcttcctctgctgtcgagacgttcctgtctgcttcccgggagcctcacgtgctccttgtcctaaccagcccccgcgcgccatcttcccgtggagtgtggggaagctgctgtctcccaggaagtgccttactcatcccgcaaccagtcagcgcaccagtggtctcccggtgtgattttttttttttttaatttcagttgtttgtaataagtagaatacactactgtaaacatacgacctttgtttttgtcttatgttggggtaaaggaaagcaggaaggggaatttttatcctcctcccttccgtaaagtgctgggatattttgaatcccccaagttcccttggacctactgatgagagatagttttatgtatggggaaaaatggatactttttaaaccttttttggcagctcagatggtgtaaattttaaaattttgtataggtatttcataacaaaaatatgtatttcttttttgttattttatcttgaaaacggtacatattttagtatttgtgcagaaaaacaagtcctaaagtatttgtttttatttgtaccatccacttgtgccttactgtatcctgtgtcatgtccaatcagttgtaaacaatggcatctttgaacagtgtgatgagaataggaatgtggtgttttaaagcagtgttgcattttaatcagtaatctacctggtggatttgtttttaaccaaaaagatgaattatcaatgatttgtaattatatcggttgattttttttgaaaagatgaaccaaaggatttgactgctaatattttattccttacactttttttctgaataagtctctcataatgagtgcagtgtcagactgtgcctactctgatggtatgtgccatttgtaaaataaaatagagcagaaaaacacaaaaagagaacactggttcagacattcagtgggcaagtaaattatggactgcaaaataatgatttttattcaagaaagctttaaaagttttatatccagatatacaaccacaataaagcaaaataacctactatc

SEQ ID NO: 279718 - DNA, 4102 bp, Homo sapiens
acttctggggcagccgtgagcagcgggcacacgggcagccacgaaagcagcagcgagggtggtgcaaacacctcataactacaccgaatccagtagcgcctggcgcccccggcgcgcaaggccgcctctactccgcctcatctttgtcccaagtcctttcacagcctgccttcctcaaacggcccgatgcgcccccgtctttgccggagtaagcagaccgccagcagccggcccgcaggtcagtcgaccctctctggatgcaggtcgccgggaaaacccggagcggagcatccctcgggccgggaaacgccctcggcgcgcacccactggcgcgcatgctcagtccgcgcggcggctgcgagtaggaagctccgcgcggcggcgggggcggcgacggcgactggcgggtgggagtggaggcaccggctggcgggcgggggtacagggacggggcaggggctcccgctccaggttccttgaagcacttccgaccgcgaagcccggcgcgagaagcgagctaacccaagagccaacaacgagcgcggagagggcagcggactgagcggagccgccggccagagcgggctcggagcccgggtctccgccgctcgggacccggctaggcggcggcgggggcggcgatgttccactgcatccccctgtggcggtgcaaccgtcatgtggagagcatcgacaagcgccactgctcgctggtctacgtccccgaggagatctaccgctatgcccggagcctggaggagctgctgctggacgccaaccagctccgcgagctgcccgagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaatctttataacctggcttcactggaactgagagagaatcttcttacatatcttcctgactctcttacccagctgcgaagactagaagaacttgatttaggaaacaatgaaatatataatttgccagaatcaattggagccctcttacatctaaaagatctctggttggatggaaatcaactgtcagaattacctcaggaaataggaaatctgaagaacctgctgtgtttagatgtctctgaaaacaggttggaaagacttcctgaagaaatcagtggcctgacttcattaacggatttagtcatttcccagaacttattagaaacgattccggatggcattggaaaactaaagaaactgtcaatcttgaaggtggatcagaatagactcacacagttgcctgaagcagttggggaatgtgaaagtctcactgagttagttcttacagaaaatcagctcctgaccctgcctaaaagcattggaaaactaaagaagttgagcaacttgaatgcagacagaaataaattagtgtccttaccaaaagagatcggcgggtgctgcagcctcactgtgttctgtgtacgtgacaacagactaactcggatacctgcagaggtgtcacaggcaacagaacttcatgtcctggatgtggcagggaacaggttgctgcatctacctttatccctgactgccttgaagttgaaggctctgtggctatctgacaaccagtcccagcccctgcttacattccagacagacacagactacaccacaggagagaagattttaacctgtgtcttacttcctcagctgccttctgaacctacttgtcaagagaatctgcctcgctgtggtgcactggagaacttggtaaatgatgtctctgatgaagcctggaacgagcgtgctgtcaacagagtcagtgcgatccgatttgtggaggatgagaaagatgaagaagacaatgagacgagaacacttctaaggcgagccactccacacccaggggagttaaagcacatgaaaaagacagtggagaatttacggaatgacatgaatgctgctaaaggactggactcaaacaaaaacgaggtcaatcatgccattgaccgagtgaccacttctgtgtagagtttcacctccaagttttacctcctgtgtcttcctctgctgtcgagacgttcctgtctgcttcccgggagcctcacgtgctccttgtcctaaccagcccccgcgcgccatcttcccgtggagtgtggggaagctgctgtctcccaggaagtgccttactcatcccgcaaccagtcagcgcaccagtggtctcccggtgtgattttttttttttttaatttcagttgtttgtaataagtagaatacactactgtaaacatacgacctttgtttttgtcttatgttggggtaaaggaaagcaggaaggggaatttttatcctcctcccttccgtaaagtgctgggatattttgaatcccccaagttcccttggacctactgatgagagatagttttatgtatggggaaaaatggatactttttaaaccttttttggcagctcagatggtgtaaattttaaaattttgtataggtatttcataacaaaaatatgtatttcttttttgttattttatcttgaaaacggtacatattttagtatttgtgcagaaaaacaagtcctaaagtatttgtttttatttgtaccatccacttgtgccttactgtatcctgtgtcatgtccaatcagttgtaaacaatggcatctttgaacagtgtgatgagaataggaatgtggtgttttaaagcagtgttgcattttaatcagtaatctacctggtggatttgtttttaaccaaaaagatgaattatcaatgatttgtaattatatcggttgattttttttgaaaagatgaaccaaaggatttgactgctaatattttattccttacactttttttctgaataagtctctcataatgagtgcagtgtcagactgtgcctactctgatggtatgtgccatttgtaaaataaaatagagcagaaaaacacaaaaagagaacactggttcagacattcagtgggcaagtaaattatggactgcaaaataatgatttttattcaagaaagctttaaaagttttatatccagatatacaaccacaataaagcaaaataacctactatcaaaatagaaatgttgctatctttataagtgcaatttaatttgtaaatagagtttgaatcaaagtatcacaaaatactgcttcaagatttaattttaaatctgctaatttaagggatattgggaaaagttttggtgtgtttctgttgatttcttttttgtatgctgtgataaaagagaaatgaaaagtgccagtcactgtgtggtgtctaggaaaatcatatatatttttttctccaagaaataaattcatcctggacattggcatacagctttttaaaattattactttgtatgttcaagtgatagcaggtagccaaattctttgacagtgtgctctggtctgttaaatatctaaattacccgtcagttgtgagtgacctcctgtgggacttgcattcacatggggcagagcccagaattgcctttgactctggctagtaattttgggttgtggctatctggcccaattggactccttataaacccgtcttcaaccaaccaaatacaatacttttttttacttctatacatttacttattgggttcacttagctttttagtctgtgtgtatgtaaatatgtgtgtattttaaaaactatttatggagctgaaagtacataacacataagtgagtttcggctggtcagttttataccttgttccctaatctgtgcataccaattttcttttctctgttttaagatttttgacatcctctattttgttttaagcttataaagataatgccactatctcatgggctgattatatataagcaaattggttttatttaatgagaattgtcttgacgtggaagaaca

SEQ ID NO: 279719 - DNA, 2881 bp, Homo sapiens
taccacccacacccgacacacgacaccccaccacaccagcaccacaccacacacacaccacccacctaccaacggctaggtacgaggctgtgtgttattcggccgaggacaggttggaaagacttcctgaagaaatcagtggcctgacttcattaacggatttagtcatttcccagaacttattagaaacgattccggatggcattggaaaactaaagaaactgtcaatcttgaaggtggatcagaatagactcacacagttgcctgaagcagttggggaatgtgaaagtctcactgagttagttcttacagaaaatcagctcctgaccctgcctaaaagcattggaaaactaaagaagttgagcaacttgaatgcagacagaaataaattagtgtccttaccaaaagagatcggcgggtgctgcagcctcactgtgttctgtgtacgtgacaacagactaactcggatacctgcagaggtgtcacaggcaacagaacttcatgtcctggatgtggcagggaacaggttgctgcatctacctttatccctgactgccttgaagttgaaggctctgtggctatctgacaaccagtcccagcccctgcttacattccagacagacacagactacaccacaggagagaagattttaacctgtgtcttacttcctcagctgccttctgaacctacttgtcaagagaatctgcctcgctgtggtgcactggagaacttggtaaatgatgtctctgatgaagcctggaacgagcgtgctgtcaacagagtcagtgcgatccgatttgtggaggatgagaaagatgaagaagacaatgagacgagaacacttctaaggcgagccactccacacccaggggagttaaagcacatgaaaaagacagtggagaatttacggaatgacatgaatgctgctaaaggactggactcaaacaaaaacgaggtcaatcatgccattgaccgagtgaccacttctgtgtagagtttcacctccaagttttacctcctgtgtcttcctctgctgtcgagacgttcctgtctgcttcccgggagcctcacgtgctccttgtcctaaccagcccccgcgcgccatcttcccgtggagtgtggggaagctgctgtctcccaggaagtgccttactcatcccgcaaccagtcagcgcaccagtggtctcccggtgtgattttttttttttttaatttcagttgtttgtaataagtagaatacactactgtaaacatacgacctttgtttttgtcttatgttggggtaaaggaaagcaggaaggggaatttttatcctcctcccttccgtaaagtgctgggatattttgaatcccccaagttcccttggacctactgatgagagatagttttatgtatggggaaaaatggatactttttaaaccttttttggcagctcagatggtgtaaattttaaaattttgtataggtatttcataacaaaaatatgtatttcttttttgttattttatcttgaaaacggtacatattttagtatttgtgcagaaaaacaagtcctaaagtatttgtttttatttgtaccatccacttgtgccttactgtatcctgtgtcatgtccaatcagttgtaaacaatggcatctttgaacagtgtgatgagaataggaatgtggtgttttaaagcagtgttgcattttaatcagtaatctacctggtggatttgtttttaaccaaaaagatgaattatcaatgatttgtaattatatcggttgattttttttgaaaagatgaaccaaaggatttgactgctaatattttattccttacactttttttctgaataagtctctcataatgagtgcagtgtcagactgtgcctactctgatggtatgtgccatttgtaaaataaaatagagcagaaaaacacaaaaagagaacactggttcagacattcagtgggcaagtaaattatggactgcaaaataatgatttttattcaagaaagctttaaaagttttatatccagatatacaaccacaataaagcaaaataacctactatcaaaatagaaatgttgctatctttataagtgcaatttaatttgtaaatagagtttgaatcaaagtatcacaaaatactgcttcaagatttaattttaaatctgctaatttaagggatattgggaaaagttttggtgtgtttctgttgatttcttttttgtatgctgtgataaaagagaaatgaaaagtgccagtcactgtgtggtgtctaggaaaatcatatatatttttttctccaagaaataaattcatcctggacattggcatacagctttttaaaattattactttgtatgttcaagtgatagcaggtagccaaattctttgacagtgtgctctggtctgttaaatatctaaattacccgtcagttgtgagtgacctcctgtgggacttgcattcacatggggcagagcccagaattgcctttgactctggctagtaattttgggttgtggctatctggcccaattggactccttataaacccgtcttcaaccaaccaaatacaatacttttttttacttctatacatttacttattgggttcacttagctttttagtctgtgtgtatgtaaatatgtgtgtattttaaaaactatttatggagctgaaagtacataacacataagtgagtttcggctggtcagttttataccttgttccctaatctgtgcataccaattttcttttctctgttttaagatttttgacatcctctattttgttttaagcttataaagataatgccactatctcatgggctgattatatataagcaaattggttttatttaatgagaattgtcttgacgtggaagaaca

SEQ ID NO: 279720 - DNA, 3550 bp, Homo sapiens
gcggaatcctaaaccagcccaatttacatccattcatgaatctgtgacgtcagcaagcctttgggctcctttgcggtgggctggaggattgtgtgggtggaatccccctcccctttatttttccaattctgcaaggcttttaaaattcaccttacatcttttcaaagcaagaaaatggaacagcatgtgtaggaattcttcgttgttgttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaactgaagacataaagattcagttcagcaggtcaggcagtggcagtggtgggtttcttgaaggactatttggatgcttaaggcctgtatggaatatcattgggaaggcatattccactgattacaaattgcagcagcaagatacttgggaagtgccatttgaggagatctcagagctgcagtggctgggtagtggagcccaaggagcggtcttcttgggcaagttccgggcggaagaggtggccatcaagaaagtgagagaacagaatgagacggatatcaagcatttgaggaagttgaagcaccctaacatcatcgcattcaagggtgtttgtactcaggccccatgttattgtattatcatggaatactgtgcccatggacaactctacgaggtcttacgagctggcaggaagatcacacctcgattgctagtagactggtccacaggaattgcaagtggaatgaattatttgcacctccataaaattattcatcgtgatctcaaatcacctaatgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggcagagtaaacctcgaaaccgaccttcttttcggcagacactcatgcatttagacattgcctctgcagatgtacttgccaccccacaagaaacttacttcaagtctcaggctgaatggagagaagaagtgaaaaaacattttgagaagatcaaaagtgaaggaacttgtatacaccggttagatgaagaactgattcgaaggcgcagagaagagctcaggcatgcgctggatattcgtgaacactatgagcggaagcttgagcgggcgaataatttatacatggaattgagtgccatcatgctgcagctagaaatgcgggagaaggagctcattaagcgtgagcaagcagtggaaaagaagtatcctgggacctacaaacgacaccctgttcgtcctatcatccatcccaatgccatggagaaactcatgaaaaggaaaggagtgcctcacaaatctgggatgcagaccaaacggccagacttgttgagatcagaagggatccccaccacagaagtggctcccactgcatcccctttgtccggaagtcccaaaatgtccacttctagcagcaagagccgatatcgaagcaaaccacgccaccgccgagggaatagcagaggcagccatagtgactttgccgcaatcttgaaaaaccagccagcccaggaaaattcaccccatcccacttacctgcaccaagctcaatcccaatacccttctcttcatcaccataattctctgcagcagcaataccagcagccccctcctgccatgtcccagagtcaccatcccagactcaatatgcacggacaggacatagcaacctgcgccaacaacctgaggtatttcggcccagcagcagccctgcggagcccactcagcaaccatgctcagagacagctgcccggctcgagccctgacctcatctccacagccatggctgcagactgctggagaagttctgagcctgacaagggccaagctggtccctggggctgttgccaggctgacgcttatgacccctgccttcagtgcaggccagaacagtatgggtccttagacataccctctgctgagccagtggggaggagccctgacctttccaagtcaccagcacataatcctctcttggaaaacgcccagagttctgagaaaacggaagaaaatgaattcagcggctgtaggtctgagtcatccctcggcacctctcatctcggcacccctccagcgctacctcgaaaaacaaggcctctgcagaagagtggagatgactcctcagaagaggaagaaggggaagtagatagtgaagttgaatttccacgaagacagaggccccatcgctgtatcagcagctgccagtcatattcaacctttagctctgagaatttctctgtgtctgatggagaagagggaaataccagtgaccactcaaacagtcctgatgagttagctgataaacttgaagaccgcttggcagagaagctagacgacctgctgtcccagacgccagagattcccattgacatatcctcacactcggatgggctctctgacaaggagtgtgccgtgcgccgtgtgaagactcagatgtctctgggcaagctgtgtgtggaggaacgtggctatgagaaccccatgcagtttgaagaatcggactgtgactcttcagatggggagtgttctgatgccacagttaggaccaataaacactacagctctgctacctggtaatgaaggaatacacatcctgaagatctcgtgactatactggcatttcagatccaccccacccccagactcatcccactctctcccagcattttgtctgggaagagagactaccccatctttaccaccccctagaaatgagctgcaataacaggaacatgagacttcgcaaatctctggaaaataatatccaaatgaaattaagtctcactgaacatttcaatcaagaatggcagggatctattttattgaatattctagctactgtaacattgatatttatttttgtttgacattttaacactttgtactgcaaagagtgaactatatatgagatagagagacaataatttcttgcaa

SEQ ID NO: 279721 - DNA, 947 bp, Homo sapiens
ctggcggctgctggtagttccatgctgtctgttcagacttcagcttggtgttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaactgaagacataaagattcagttcagcagatacttgggaagtgccatttgaggagatctcagagctgcagtggctgggtagtggagcccaaggagcggtcttcttgggcaagttccgggcggaagaggtggccatcaagaaagtgagagaacagaatgagacggatatcaagcatttgaggaagttgaagcaccctaacatcatcgcattcaagggtgtttgtactcaggccccatgttattgtattatcatggaatactgtgcccatggacaactctacgaggtcttacgagctggcaggaagatcacacctcgattgctagtagactggtccacaggaattgcaagtggaatgaattatttgcacctccataaaattattcatcgtgatctcaaatcacctaagtgagttctggggctaatgtttcagctattttggtttgttgttttgaaatacagaatttttatcaacctcag

SEQ ID NO: 279722 - DNA, 2074 bp, Homo sapiens
gccttcagtcccgttgtgtggacatttcaaggatgtggccattgatgttgttaaatgtgttgctagcccactagaaacttacttcaagtctcaggctgaatggagagaagaagtgaaaaaacattttgagaagatcaaaagtgaaggaacttgtatacaccggttagatgaagaactgattcgaaggcgcagagaagagctcaggcatgcgctggatattcgtgaacactatgagcggaagcttgagcgggcgaataatttatacatggaattgagtgccatcatgctgcagctagaaatgcgggagaaggagctcattaagcgtgagcaagcagtggaaaagaagtatcctgggacctacaaacgacaccctgttcgtcctatcatccatcccaatgccatggagaaactcatgaaaaggaaaggagtgcctcacaaatctgggatgcagaccaaacggccagacttgttgagatcagaagggatccccaccacagaagtggctcccactgcatcccctttgtccggaagtcccaaaatgtccacttctagcagcaagagccgatatcgaagcaaaccacgccaccgccgagggaatagcagaggcagccatagtgactttgccgcaatcttgaaaaaccagccagcccaggaaaattcaccccatcccacttacctgcaccaagctcaatcccaatacccttctcttcatcaccataattctctgcagcagcaataccagcagccccctcctgccatgtcccagagtcaccatcccagactcaatatgcacggacaggacatagcaacctgcgccaacaacctgaggtatttcggcccagcagcagccctgcggagcccactcagcaaccatgctcagagacagctgcccggctcgagccctgacctcatctccacagccatggctgcagactgctggagaagttctgagcctgacaagggccaagctggtccctggggctgttgccaggctgacgcttatgacccctgccttcagtgcaggccagaacagtatgggtccttagacataccctctgctgagccagtggggaggagccctgacctttccaagtcaccagcacataatcctctcttggaaaacgcccagagttctgagaaaacggaagaaaatgaattcagcggctgtaggtctgagtcatccctcggcacctctcatctcggcacccctccagcgctacctcgaaaaacaaggcctctgcagaagagtggagatgactcctcagaagaggaagaaggggaagtagatagtgaagttgaatttccacgaagacagaggccccatcgctgtatcagcagctgccagtcatattcaacctttagctctgagaatttctctgtgtctgatggagaagagggaaataccagtgaccactcaaacagtcctgatgagttagctgataaacttgaagaccgcttggcagagaagctagacgacctgctgtcccagacgccagagattcccattgacatatcctcacactcggatgggctctctgacaaggagtgtgccgtgcgccgtgtgaagactcagatgtctctgggcaagctgtgtgtggaggaacgtggctatgagaaccccatgcagtttgaagaatcggactgtgactcttcagatggggagtgttctgatgccacagttaggaccaataaacactacagctctgctacctggtaatgaaggaatacacatcctgaagatctcgtgactatactggcatttcagatccaccccacccccagactcatcccactctctcccagcattttgtctgggaagagagactaccccatctttaccaccccctagaaatgagctgcaataacaggaacatgagacttcgcaaatctctggaaaataatatccaaatgaaattaagtctcactgaacatttcaatcaagaatggcagggatctattttattgaatattctagctactgtaacattgatatttatttttgtttgacattttaacactttgtactgcaaagagtgaactatatatgagatagagagacaataatttcttgcaa

SEQ ID NO: 279723 - DNA, 1943 bp, Homo sapiens
  misc_feature (1619)..(1619): n is a, c, g, or t
  misc_feature (1624)..(1624): n is a, c, g, or t
gcggaatcctaaaccagcccaatttacatccattcatgaatctgtgacgtcagcaagcctttgggctcctttgcggtgggctggaggattgtgtgggtggaatccccctcccctttatttttccaattctgcaaggcttttaaaattcaccttacatcttttcaaagcaagaaaatggaacagcatgtgtaggaattcttcgttgttgttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaactgaagacataaagattcagttcagcaggtcaggcagtggcagtggtgggtttcttgaaggactatttggatgcttaaggcctgtatggaatatcattgggaaggcatattccactgattacaaattgcagcagcaagatacttgggaagtgccatttgaggagatctcagagctgcagtggctgggtagtggagcccaaggagcggtcttcttgggcaagttccgggcggaagaggtggccatcaagaaagtgagagaacagaatgagacggatatcaagcatttgaggaagttgaagcaccctaacatcatcgcattcaatgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggcagagtaaacctcgaaaccgaccttcttttcggcagacactcatgcatttagacattgcctctgcagatgtacttgccaccccacaagaaacttacttcaagtctcaggctgaatggagagaagaagtgaaaaaacattttgagaagatcaaaagtgaaggaacttgtatacaccggttagatgaagaactgattcgaaggcgcagagaagagctcaggcatgcgctggatattcgtgaacactatgagcggaagcttgagcgggcgaataatttatacatggaattgagtgccatcatgctgcagctagaaatgcgggagaaggagctcattaagcgtgagcagcagnggaangaagatccggggaccctaaaaggaacaccggtacgcacaataatcatatccaaagtgcagggagacactcatggacacgggaacaaggagggtgcgcaccaacaactttgggggaaggcggaccccaaagggggcagaacggtgaacacagaaagggactccacaaaataaagagggtacaccagggataccctgtaacgggagacaaaaaagagccacatcaacaaacagaaataaaaacaagaacaacaaaagagggcacgatacgaccacgagagacacgaccacagaacacagaggagaatagaaaagcaacacc

SEQ ID NO: 279724 - DNA, 465 bp, Homo sapiens
cagagttgtcccagatgtttctgtttttcttatagcagtattagaattttaaaactgggtatatgtactaatttgatttcaattaatagagaactaaaatacaaatcagtctttctgaaacatcttctgtccatgttcccggcgctactgtaggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggtaagaatattgtctctaaaacaatagggaggtctctaatgtgtatttggagtaaatatcctggtggtggaaagaataggagctttggagtaggagaatcttgggttcaaatactagctctgcccctttctatctgtgcaattttgggcacgt

SEQ ID NO: 279725 - DNA, 315 bp, Homo sapiens
ccgccccccacccccgccccggccctttgtacagcaattgcaacaagtgggagcagagggtgagaggagccggggccaccagggagggagggcgcgccggcagccggaagggagtggggagggcacgagccggggagagcggtgttggccatggagacgtggggagactggaggccgaggcttggggacccgactgtcatcagggtcttccgccagaccctgggcgctgcgccctcagaggccgatgaaaagaagcagaagggagaggtgagtaagtcgcagctccgggcgccggctcccgggaccccgtggggc

SEQ ID NO: 279726 - DNA, 1522 bp, Homo sapiens
cgggcggcgcgggcggcgcgggggcgctggggctggaggggcggggcgcgcgcgctccctcgctggcggagcggctgggcggcgggccgggcccggggccgcttggaatggcgcctcctccgccttcgccccaactgcttctcctggcagccctcgcgaggctcctgggtcccagcgaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctgctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtaga

SEQ ID NO: 279727 - DNA, 2345 bp, Homo sapiens
gcggccgcgcgcgcgctctgccctcgggcggccctgctctcccccgcccggccccgcaaccccgcaataacttggctgggcggggtccggcactgggctagagaggtcgagcgcggcgtcttgagccgctggcgggaggctgctgcttccccgcctgcatcagtgcgggtcccgtggactcctcgcccccgtccccgcgagctcggggctccacatcaaggaaatcctcagcccgggagtggcttccccagaaacagcagccccaagcctccgagagtcagtcggagaaaaggacacactcaggcgccctgcgacagggatgcccgtccgacctacaaggaacgcctcgtaaaccggggtgcatgggagaccacggaaataacacgttctcgctgtttccaagctttgggataggcatctcgaccctcgctctctacccacgtttcccccccaaatcctggagagggaaccagaaccagcgccccgctgcggggcgggccggccagcgcacctcctgggggtgaggcctgtggcgtccccatctcgcggcgaccaatctctttctagacgcgcgcctgccaccgctgggcgacggcggaggtggggaagacagcagcctctcggctagctccggcctcccggggcttctgggtttggagagtttggggagcggagacacctcccgaggctcctccgcgttggaccctatttgcgagggcgggagcggggtgggccgacggcgaagctccagaggtgggaccctctcccttcagcagctcttcctgacttcatgattctgcccctcttctcattgcaggtcacaccgacaaatctgaagcgggtttgccaggggagtgtacccgtctccccagcctgggccacccggtccacagggattccatttccggccttacactccgctccacgatctcatccaggcgctgcagctgtgcagctgctctacagactgcagggacctgctgagacgaatccccggacgaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctgctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtaga

SEQ ID NO: 279728 - DNA, 2370 bp, Homo sapiens
gcggccgcgcgcgcgctctgccctcgggcggccctgctctcccccgcccggccccgcaaccccgcaataacttggctgggcggggtccggcactgggctagagaggtcgagcgcggcgtcttgagccgctggcgggaggctgctgcttccccgcctgcatcagtgcgggtcccgtggactcctcgcccccgtccccgcgagctcggggctccacatcaaggaaatcctcagcccgggagtggcttccccagaaacagcagccccaagcctccgagagtcagtcggagaaaaggacacactcaggcgccctgcgacagggatgcccgtccgacctacaaggaacgcctcgtaaaccggggtgcatgggagaccacggaaataacacgttctcgctgtttccaagctttgggataggcatctcgaccctcgctctctacccacgtttcccccccaaatcctggagagggaaccagaaccagcgccccgctgcggggcgggccggccagcgcacctcctgggggtgaggcctgtggcgtccccatctcgcggcgaccaatctctttctagacgcgcgcctgccaccgctgggcgacggcggaggtggggaagacagcagcctctcggctagctccggcctcccggggcttctgggtttggagagtttggggagcggagacacctcccgaggctcctccgcgttggaccctatttgcgagggcgggagcggggtgggccgacggcgaagctccagaggtgggaccctctcccttcagcagctcttcctgacttcatgattctgcccctcttctcattgcaggtcacaccgacaaatctgaagcgggtttgccaggggagtgtacccgtctccccagcctgggccacccggtccacagggattccatttccggccttacactccgctccacgatctcatccaggcgctgcagctgtgcagctgctctacagactgcagggacctgctgagacgaatccccggacgaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggctctaacagttacctcctctcgtagcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctgctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtaga

SEQ ID NO: 279729 - DNA, 2128 bp, Homo sapiens
gcggccgcgcgcgcgctctgccctcgggcggccctgctctcccccgcccggccccgcaaccccgcaataacttggctgggcggggtccggcactgggctagagaggtcgagcgcggcgtcttgagccgctggcgggaggctgctgcttccccgcctgcatcagtgcgggtcccgtggactcctcgcccccgtccccgcgagctcggggctccacatcaaggaaatcctcagcccgggagtggcttccccagaaacagcagccccaagcctccgagagtcagtcggagaaaaggacacactcaggcgccctgcgacagggatgcccgtccgacctacaaggaacgcctcgtaaaccggggtgcatgggagaccacggaaataacacgttctcgctgtttccaagctttgggataggcatctcgaccctcgctctctacccacgtttcccccccaaatcctggagagggaaccagaaccagcgccccgctgcggggcgggccggccagcgcacctcctgggggtgaggcctgtggcgtccccatctcgcggcgaccaatctctttctagacgcgcgcctgccaccgctgggcgacggcggaggtcacaccgacaaatctgaagcgggtttgccaggggagtgtacccgtctccccagcctgggccacccggtccacagggattccatttccggccttacactccgctccacgatctcatccaggcgctgcagctgtgcagctgctctacagactgcagggacctgctgagacgaatccccggacgaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctgctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtaga

SEQ ID NO: 279730 - DNA, 2134 bp, Homo sapiens
gcggccgcgcgcgcgctctgccctcgggcggccctgctctcccccgcccggccccgcaaccccgcaataacttggctgggcggggtccggcactgggctagagaggtcgagcgcggcgtcttgagccgctggcgggaggctgctgcttccccgcctgcatcagtgcgggtcccgtggactcctcgcccccgtccccgcgagctcggggctccacatcaaggaaatcctcagcccgggagtggcttccccagaaacagcagccccaagcctccgagagtcagtcggagaaaaggacacactcaggcgccctgcgacagggatgcccgtccgacctacaaggaacgcctcgtaaaccggggtgcatgggagaccacggaaataacacgttctcgctgtttccaagctttgggataggcatctcgaccctcgctctctacccacgtttcccccccaaatcctggagagggaaccagaaccagcgccccgctgcggggcgggccggccagcgcacctcctgggggtcacaccgacaaatctgaagcgggtttgccaggggagtgtacccgtctccccagcctgggccacccggtccacagggattccatttccggccttacactccgctccacgatctcatccaggcgctgcagctgtgcagctgctctacagactgcagggacctgctgagacgaatccccggacgaggaaaggggccccccgcctgccctactgagccttgcgcgctgacccggttcctacacttaacttttccggcttcgggtttaagacgcgtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctgctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtaga

SEQ ID NO: 279731 - DNA, 1631 bp, Homo sapiens
cgtagggccagggcaggccggcctcgaaccactctcggcagcgcagcacgggcgagatgcaggcggcgcctgtcacgtagctggaggagccgcactcgcccaggtcacaccgacaaatctgaagcgggtttgccaggggagtgtacccgtctccccagcctgggccacccggtccacagggattccatttccggccttacactccgctccacgatctcatccaggcgctgcagctgtgcagctgctctacagactgcagggacctgctgagacgaatccccggacgaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctgctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtaga

SEQ ID NO: 279732 - DNA, 1681 bp, Homo sapiens
acctacggctagtgtcgaggctgcgtgttaatcggccgaggagcggctgggcggcgggccgggcccggggccgcttggaatggcgcctcctccgccttcgccccaactgcttctcctggcagccctcgcgaggctcctgggtcccagcgaggtaaggtgacccgctcctgggaaggcctcggcccgcgagctcaaagcgctttgccaaaagttcgtcctggaaggagtggcgcgccgagggggacgcggagttcttccgctggcgggctgggcctggggagagagagggcagggcctcgccgcgtccagcgccccaactcttcgctttggacccacaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctgctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtaga

SEQ ID NO: 279733 - DNA, 1571 bp, Homo sapiens
cgggcggcgcgggcggcgcgggggcgctggggctggaggggcggggcgcgcgcgctccctcgctggcggagcggctgggcggcgggccgggcccggggccgcttggaatggcgcctcctccgccttcgccccaactgcttctcctggcagccctcgcgaggctcctgggtcccagcgaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctgctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtagacccttatctctctagtacgacacaccccccccccccttcgcccccacgc

SEQ ID NO: 279734 - DNA, 1356 bp, Homo sapiens
cgggcggcgcgggcggcgcgggggcgctggggctggaggggcggggcgcgcgcgctccctcgctggcggagcggctgggcggcgggccgggcccggggccgcttggaatggcgcctcctccgccttcgccccaactgcttctcctggcagccctcgcgaggctcctgggtcccagcgaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgtgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtaga

SEQ ID NO: 279735 - DNA, 1624 bp, Homo sapiens
gcggccgcgcgcgcgctctgccctcgggcggccctgctctcccccgcccggccccgcaaccccgcaataacttggctgggcggggtccggcactgggctagagaggtcgagcgcggcgtcttgagccgctggcgggaggctgctgcttccccgcctgcatcagtgcgggtcccgtggactcctcgcccccgtccccgcgagctcggggctccacatcaaggaaatcctcagcccgggagtggcttccccagaaacagcagccccaagcctccgagagtcagtcggagaaaaggacacactcaggcgccctgcgacagggatgcccgtccgacctacaaggaacgcctcgtaaaccggggtgcatgggagaccacggaaataacacgttctcgctgtttccaagctttgggataggcatctcgaccctcgctctctacccacgtttcccccccaaatcctggagagggaaccagaaccagcgccccgctgcggggcgggccggccagcgcacctcctgggggtgaggcctgtggcgtccccatctcgcggcgaccaatctctttctagacgcgcgcctgccaccgctgggcgacggcggaggtggggaagacagcagcctctcggctagctccggcctcccggggcttctgggtttggagagtttggggagcggagacacctcccgaggctcctccgcgttggaccctatttgcgagggcgggagcggggtgggccgacggcgaagctccagaggtgggaccctctcccttcagcagctcttcctgacttcatgattctgcccctcttctcattgcaggtcacaccgacaaatctgaagcgggtttgccaggggagtgtacccgtctccccagcctgggccacccggtccacagggattccatttccggccttacactccgctccacgatctcatccaggcgctgcagctgtgcagctgctctacagactgcagggacctgctgagacgaatccccggacgaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagcctgggatgggcacaggggtggtagaggaaggtgacatc

SEQ ID NO: 279736 - DNA, 366 bp, Homo sapiens
acctacggctagtgtcgaggctgcgtgttaatcggccgaggagcggctgggcggcgggccgggcccggggccgcttggaatggcgcctcctccgccttcgccccaactgcttctcctggcagccctcgcgaggctcctgggtcccagcgaggtgatggctggaccggcggaggaggcgggagcccattgtcccgagagcctgtggcctctgcctccgcaggtgtcaccaagagtgacctacacacgagtgagcccagggcaggtgagtacaagcaggggcccaccacccttggtgtccacgcctggagacaggcgctcctagcaggcttcgctgcctgttctgctgatcggccccattccttacca

SEQ ID NO: 279737 - DNA, 2174 bp, Homo sapiens
gcggccgcgcgcgcgctctgccctcgggcggccctgctctcccccgcccggccccgcaaccccgcaataacttggctgggcggggtccggcactgggctagagaggtcgagcgcggcgtcttgagccgctggcgggaggctgctgcttccccgcctgcatcagtgcgggtcccgtggactcctcgcccccgtccccgcgagctcggggctccacatcaaggaaatcctcagcccgggagtggcttccccagaaacagcagccccaagcctccgagagtcagtcggagaaaaggacacactcaggcgccctgcgacagggatgcccgtccgacctacaaggaacgcctcgtaaaccggggtgcatgggagaccacggaaataacacgttctcgctgtttccaagctttgggataggcatctcgaccctcgctctctacccacgtttcccccccaaatcctggagagggaaccagaaccagcgccccgctgcggggcgggccggccagcgcacctcctgggggtgaggcctgtggcgtccccatctcgcggcgaccaatctctttctagacgcgcgcctgccaccgctgggcgacggcggaggtcacaccgacaaatctgaagcgggtttgccaggggagtgtacccgtctccccagcctgggccacccggtccacagggattccatttccggccttacactccgctccacgatctcatccaggcgctgcagctgtgcagctgctctacagactgcagggacctgctgagacgaatccccggacgaggaaaggggccccccgcctgccctactgagccttgcgcgctgacccggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctgctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtaga

SEQ ID NO: 279738 - DNA, 1494 bp, Homo sapiens
acctacggctagtgtcgaggctgcgtgttaatcggccgaggagcggctgggcggcgggccgggcccggggccgcttggaatggcgcctcctccgccttcgccccaactgcttctcctggcagccctcgcgaggctcctgggtcccagcgaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctgctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtaga

SEQ ID NO: 279739 - DNA, 1998 bp, Homo sapiens
ccgccccccacccccgccccggccctttgtacagcaattgcaacaagtgggagcagagggtgagaggagccggggccaccagggagggagggcgcgccggcagccggaagggagtggggagggcacgagccggggagagcggtgttggccatggagacgtggggagactggaggccgaggcttggggacccgactgtcatcagggtcttccgccagaccctgggcgctgcgccctcagaggccgatgaaaagaagcagaagggagagctttgggataggcatctcgaccctcgctctctacccacgtttcccccccaaatcctggagagggaaccagaaccagcgccccgctgcggggcgggccggccagcgcacctcctgggggtcacaccgacaaatctgaagcgggtttgccaggggagtgtacccgtctccccagcctgggccacccggtccacagggattccatttccggccttacactccgctccacgatctcatccaggcgctgcagctgtgcagctgctctacagactgcagggacctgctgagacgaatccccggacgaggaaaggggccccccgcctgccctactgagccttgcgcgctgacccggttcctacacttaacttttccggcttcgggtttaagacgcgtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctgctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtaga

SEQ ID NO: 279740 - DNA, 1636 bp, Homo sapiens
cgggcggcgcgggcggcgcgggggcgctggggctggaggggcggggcgcgcgcgctccctcgctggcggagcggctgggcggcgggccgggcccggggccgcttggaatggcgcctcctccgccttcgccccaactgcttctcctggcagccctcgcgaggctcctgggtcccagcgaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctggtgaggagttccctccctaccctacccgaggcccccgccccacctcgcgtcgcccgccgccccccgtagcttccctgccctcccgcccttgactgctcggcgcccggcccacagctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtaga

SEQ ID NO: 279741 - DNA, 1430 bp, Homo sapiens
cgggcggcgcgggcggcgcgggggcgctggggctggaggggcggggcgcgcgcgctccctcgctggcggagcggctgggcggcgggccgggcccggggccgcttggaatggcgcctcctccgccttcgccccaactgcttctcctggcagccctcgcgaggctcctgggtcccagcgaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctgctgtgctgaagcggaggctgctgcagccctcgcgccgggtcaagcgctcgcgccggagacccctcctcccgcccacgccggacagcggcccggaaggcgagagctcggagtgacggcctgggacctgccactggccgagcactgcgggggctttcctccttgttggttgctgagtgggcggccaaggggagaaaaggagccgcttctgcctcccttgccaaaactccgtttctaattaaattatttttagtaga

SEQ ID NO: 279742 - DNA, 1325 bp, Homo sapiens
cgggcggcgcgggcggcgcgggggcgctggggctggaggggcggggcgcgcgcgctccctcgctggcggagcggctgggcggcgggccgggcccggggccgcttggaatggcgcctcctccgccttcgccccaactgcttctcctggcagccctcgcgaggctcctgggtcccagcgaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtaga

SEQ ID NO: 279743 - DNA, 625 bp, Homo sapiens
gaagtaactctgccaacaccttgatctcagatttctagcctccaaagacaatgtcaagagaatgagaagacaagcctcagaatgagaagaaacatttgtaaaagatacatctaataaagcagttttatccaaaatatataatacaaagatctcttgagactcaacattaaggaagcaaacaaccagaataaaaaatgagctccagatactaacagccacctcatcaaagacaatacacagataacaaattaccatatgaaaatgtggtctctatcatatgtcatcatggaaattcaaattaaagccacagtgagataccactacacacctataagaatagccaaaatccagaatacagacaacaccatacgctaatgaggattaggagcaacaggaactcgtattcatgctggtgggaatgcagcaaggaacatttccctctctggatacatgtgtttcagatcacaaagccatagatgagaggagtctctctttctaaatcactttttgaagaacacctactcaagagagtcacctgaccccgttggaatataagatgtgtgggaaatctaccttattgcattaaactactcagatttttgtgtggttggttaaacagtattaa

SEQ ID NO: 279744 - DNA, 411 bp, Homo sapiens
gaagtaactctgccaacaccttgatctcagatttctagcctccaaaggtggtggaatatctgagaatccacatactgtaacgaatgatgagaaaaatccagcttcttgctattgctgttaccatccatcagcatggatggacaaaggaaggaagcagatttgctagaagccaagcatcatagagtcaactagaagaagctgaaatcacagcagacctgtcttgtgaaagctggggatgtggacaagatgacagtcattgaagtactctgtgtgaaaaacagagaatgtgtaaactaaatattctggcttgtccctcccaccttccaaattgcctctagttcctcttgttaactgagctaaatggcaagccaacttgcagagcctggaaataaagcttgtaggactcatacc

SEQ ID NO: 279745 - DNA, 354 bp, Homo sapiens
ctacaggtgctcgaaaagttttccctcgatactcttcaatctggcttctactgctctatcatttaactgaaatggaacagacacggggttttgccatggtgtcaaactcttggactcaagcaatccgcccaccttggcctcccaaagtgctgagattacagagctcagagtggagttcatgcaaatcccatttattctctaactggtggagctgagactgctgaagctgggtaagaggccaagatgtggaactcatactacatatattatgaaaatcctgccatctgcagaaaagaaatacaaaagatggtgttaggaccctctccaaattaaaattctgaatttccatgaaag

SEQ ID NO: 279746 - DNA, 2168 bp, Homo sapiens
atagcttaaacatgtaattagtatcaccacaaatgagaagaatgaaaggatcacattttccccctcgttttcccttgaagtcatgaacggttggttctgctgtgactttggggcttagttttcagtagaagtgttgtcctgctctgctgctgttactgcgggactgctaattcaggctaactcaggcggcgggcgctgtgtgctctgaacatcaaaccgcgggtgaggcgtcaacccaggagtttattttgtgatcagagtggaaccactacacttcactttcccctcacctccacctctgagggagcaacgaatacaaaggtagacccccaaaagctttgaatagctgtcgcctactttcccgcggccctcttcattttttcgtctcccgctgccgccgccgccgccgcctctggatctggacggacccagtggccgctgccgcctccgcagggccgggcactactttccgtctgcggtggttccgccgaccctcccgcggctgctgccccgcccgcgccggcggaaggagacgcgctgcgcgccgccgctgcccggggagggagacggagcagtactggccgcggcgcggtggcggcggctgggctgcctcggggtcttcgacggccgcgttgggttttgtttcagttttcttgtgtggcgctgcagcacaaggctgcgaatctgggagtccaaaggagtgtttgcggggagggcccgaggtcgctgtgtccggggcagagcggccggttcgtcccgagtctgcgctctttcgggtccgctgctgtgtcccggtccgctctcctcagcatgagcggccggtaggagtgaggtttcatcggttccctcgcactggaggaggcagcggccgcttcggcagcgacagctatggcggtagagacgcgggcagagctggtgggtaagcggttcctgtgtgtggcggtcggcgacgaggcacgttcggagcgctgggagagcggacgcggctggcgaagctggcgagcgggggtcatccgagccgtgtcacacagggacagccgcaatccggacctggcggtgtatgtggaatttgatgatcttgaatgggataaacgagagtgggttaaagtttatgaagatttttcaactttcttggtggaataccacttaatctgggccaaaaggaatgaccctagccagactcagggatcaaagagcaaacagattcagtggcctgcattgactttcaaacctctggttgaaagaaatatacccagttcagtcactgcagtagaattccttgtagataagcaactggattttttaactgaagatagtgcctttcagccctaccaggacgacatagacagcctaaacccagttctcagggacaacccgcagcttcatgaggaagtgaaagtctgggtaaaggaacaaaaggttcaggagatttttatgcaaggtccttattccttaaatggatacagagtgagagtatatagacaagactctgccacccagtggtttactggcataattactcatcatgatctcttcacccgcaccatgatcgttatgaatgatcaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacagccattatacacgtgcccaagcaaatagtcccagaccagcaatgaactcccaagctgctgtaccaaaacagaatacacaccagcaacagcaacaaagaagtatccgtccgaataagaggaagggctcagatagcagtataccagatgaagagaagatgaaggaggaaaaatatgattatatatcacgaggagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcaaaaataaatggagaagaaggaaaaccccataataatgagaaggcaggagaagagaccct

SEQ ID NO: 279747 - DNA, 2001 bp, Homo sapiens
atagcttaaacatgtaattagtatcaccacaaatgagaagaatgaaaggatcacattttccccctcgttttcccttgaagtcatgaacggttggttctgctgtgactttggggcttagttttcagtagaagtgttgtcctgctctgctgctgttactgcgggactgctaattcaggctaactcaggcggcgggcgctgtgtgctctgaacatcaaaccgcgggtgaggcgtcaacccaggagtttattttgtgatcagagtggaaccactacacttcactttcccctcacctccacctctgagggagcaacgaatacaaaggtagacccccaaaagctttgaatagctgtcgcctactttcccgcggccctcttcattttttcgtctcccgctgccgccgccgccgccgcctctggatctggacggacccagtggccgcctgcctcggggtcttcgacggccgcgttgggttttgtttcagttttcttgtgtggcgctgcagcacaaggctgcgaatctgggagtccaaaggagtgtttgcggggagggcccgaggtcgctgtgtccggggcagagcggccggttcgtcccgagtctgcgctctttcgggtccgctgctgtgtcccggtccgctctcctcagcatgagcggccggtaggagtgaggtttcatcggttccctcgcactggaggaggcagcggccgcttcggcagcgacagctatggcggtagagacgcgggcagagctggtgggtaagcggttcctgtgtgtggcggtcggcgacgaggcacgttcggagcgctgggagagcggacgcggctggcgaagctggcgagcgggggtcatccgagccgtgtcacacagggacagccgcaatccggacctggcggtgtatgtggaatttgatgatcttgaatgggataaacgagagtgggttaaagtttatgaagatttttcaactttcttggtggaataccacttaatctgggccaaaaggaatgaccctagccagactcagggatcaaagagcaaacagattcagtggcctgcattgactttcaaacctctggttgaaagaaatatacccagttcagtcactgcagtagaattccttgtagataagcaactggattttttaactgaagatagtgcctttcagccctaccaggacgacatagacagcctaaacccagttctcagggacaacccgcagcttcatgaggaagtgaaagtctgggtaaaggaacaaaaggttcaggagatttttatgcaaggtccttattccttaaatggatacagagtgagagtatatagacaagactctgccacccagtggtttactggcataattactcatcatgatctcttcacccgcaccatgatcgttatgaatgatcaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacagccattatacacgtgcccaagcaaatagtcccagaccagcaatgaactcccaagctgctgtaccaaaacagaatacacaccagcaacagcaacaaagaagtatccgtccgaataagaggaagggctcagatagcagtataccagatgaagagaagatgaaggaggaaaaatatgattatatatcacgaggagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcaaaaataaatggagaagaaggaaaaccccataataatgagaaggcaggagaagagaccct

SEQ ID NO: 279748 - DNA, 1973 bp, Homo sapiens
atagcttaaacatgtaattagtatcaccacaaatgagaagaatgaaaggatcacattttccccctcgttttcccttgaagtcatgaacggttggttctgctgtgactttggggcttagttttcagtagaagtgttgtcctgctctgctgctgttactgcgggactgctaattcaggctaactcaggcggcgggcgctgtgtgctctgaacatcaaaccgcgggtgaggcgtcaacccaggagtttattttgtgatcagagtggaaccactacacttcactttcccctcacctccacctctgagggagcaacgaatacaaaggtagacccccaaaagctttgaatagctgtcgcctactttcccgcggccctcttcattttttcgtctcccgctgccgccgccgccgccgcctctggatctggacggacccagtggccgcgggttttgtttcagttttcttgtgtggcgctgcagcacaaggctgcgaatctgggagtccaaaggagtgtttgcggggagggcccgaggtcgctgtgtccggggcagagcggccggttcgtcccgagtctgcgctctttcgggtccgctgctgtgtcccggtccgctctcctcagcatgagcggccggtaggagtgaggtttcatcggttccctcgcactggaggaggcagcggccgcttcggcagcgacagctatggcggtagagacgcgggcagagctggtgggtaagcggttcctgtgtgtggcggtcggcgacgaggcacgttcggagcgctgggagagcggacgcggctggcgaagctggcgagcgggggtcatccgagccgtgtcacacagggacagccgcaatccggacctggcggtgtatgtggaatttgatgatcttgaatgggataaacgagagtgggttaaagtttatgaagatttttcaactttcttggtggaataccacttaatctgggccaaaaggaatgaccctagccagactcagggatcaaagagcaaacagattcagtggcctgcattgactttcaaacctctggttgaaagaaatatacccagttcagtcactgcagtagaattccttgtagataagcaactggattttttaactgaagatagtgcctttcagccctaccaggacgacatagacagcctaaacccagttctcagggacaacccgcagcttcatgaggaagtgaaagtctgggtaaaggaacaaaaggttcaggagatttttatgcaaggtccttattccttaaatggatacagagtgagagtatatagacaagactctgccacccagtggtttactggcataattactcatcatgatctcttcacccgcaccatgatcgttatgaatgatcaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacagccattatacacgtgcccaagcaaatagtcccagaccagcaatgaactcccaagctgctgtaccaaaacagaatacacaccagcaacagcaacaaagaagtatccgtccgaataagaggaagggctcagatagcagtataccagatgaagagaagatgaaggaggaaaaatatgattatatatcacgaggagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcaaaaataaatggagaagaaggaaaaccccataataatgagaaggcaggagaagagaccct

SEQ ID NO: 279749 - DNA, 1406 bp, Homo sapiens
atagcttaaacatgtaattagtatcaccacaaatgagaagaatgaaaggatcacattttccccctcgttttcccttgaagtcatgaacggttggttctgctgtgactttggggcttagttttcagtagaagtgttgtcctgctctgctgctgttactgcgggactgctaattcaggctaactcaggcggcgggcgctgtgtgctctgaacatcaaaccgcgggtgaggcgtcaacccaggagtttattttgtgatcagagtggaaccactacacttcactttcccctcacctccacctctgagggagcaacgaatacaaaggtagacccccaaaagctttgaatagctgtcgcctactttcccgcggccctcttcattttttcgtctcccgctgccgccgccgccgccgcctctggatctggacggacccagtggccgctgccgcctccgcagggccgggcactactttccgtctgcggtggttccgccgaccctcccgcggctgctgccccgcccgcgccggcggaaggagacgcgctgcgcgccgccgctgcccggggagggagacggagcagtactggccgcggcgcggtggcggcggctgggctgcctcggggtcttcgacggccgcgttgggttttgtttcagttttcttgtgtggcgctgcagcacaaggctgcgaatctgggagtccaaaggagtgtttgcggggagggcccgaggtcgctgtgtccggggcagagcggccggttcgtcccgagtctgcgctctttcgggtccgctgctgtgtcccggtccgctctcctcagcatgagcggccggtaggagtgaggtttcatcggttccctcgcactggaggaggcagcggccgcttcggcagcgacagctatggcggtagagacgcgggcagagctggtgggtaagcggttcctgtgtgtggcggtcggcgacgaggcacgttcggagcgctgggagagcggacgcggctggcgaagctggcgagcgggggtcatccgagccgtgtcacacagggacagccgcaatccggacctggcggtgtatgtggaatttgatgatcttgaatgggataaacgagagtgggttaaagtttatgaagatttttcaactttcttggtggaataccacttaatctgggccaaaaggaatgaccctagccagactcagggatcaaagagcaaacagattcagtggcctgcattggtaagatctattcctgtttcattaagcattttcatttgttcgtttaaaacaaagaacaacaacaacaaaacaaaggccaggtttggtgactgacacctgtaaaactagcactttgagaggctgaagcaggacaattgcttgaagccaggagttggagatcagcctgggcaaaaaagcgagacccc

SEQ ID NO: 279750 - DNA, 1230 bp, Homo sapiens
cgccgcgccgcaccgcacgcagccgagcagcgccacagccgccgccgccgtcgcagccgcagtcgccgcagctaggccctcggccgtcgcagggagctccgcagcgacgtggaccaaggtgtatgtggaatttgatgatcttgaatgggataaacgagagtgggttaaagtttatgaagatttttcaactttcttggtggaataccacttaatctgggccaaaaggaatgaccctagccagactcagggatcaaagagcaaacagattcagtggcctgcattgactttcaaacctctggttgaaagaaatatacccagttcagtcactgcagtagaattccttgtagataagcaactggattttttaactgaagatagtgcctttcagccctaccaggacgacatagacagcctaaacccagttctcagggacaacccgcagcttcatgaggaagtgaaagtctgggtaaaggaacaaaaggttcaggagatttttatgcaaggtccttattccttaaatggatacagagtgagagtatatagacaagactctgccacccagtggtttactggcataattactcatcatgatctcttcacccgcaccatgatcgttatgaatgatcaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacagccattatacacgtgcccaagcaaatagtcccagaccagcaatgaactcccaagctgctgtaccaaaacagaatacacaccagcaacagcaacaaagaagtatccgtccgaataagaggaagggctcagatagcagtataccagatgaagagaagatgaaggaggaaaaatatgattatatatcacgaggagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcaaaaataaatggagaagaaggaaaaccccataataatgagaaggcaggagaagagaccct

SEQ ID NO: 279751 - DNA, 1923 bp, Homo sapiens
atagcttaaacatgtaattagtatcaccacaaatgagaagaatgaaaggatcacattttccccctcgttttcccttgaagtcatgaacggttggttctgctgtgactttggggcttagttttcagtagaagtgttgtcctgctctgctgctgttactgcgggactgctaattcaggctaactcaggcggcgggcgctgtgtgctctgaacatcaaaccgcgggtgaggcgtcaacccaggagtttattttgtgatcagagtggaaccactacacttcactttcccctcacctccacctctgagggagcaacgaatacaaaggtagacccccaaaagctttgaatagctgtcgcctactttcccgcggccctcttcattttttcgtctcccgctgcccctcccgcggctgctgccccgcccgcgccggcggaaggagacgctgggagtccaaaggagtgtttgcggggagggcccgaggtcgctgtgtccggggcagagcggccggttcgtcccgagtctgcgctctttcgggtccgctgctgtgtcccggtccgctctcctcagcatgagcggccggtaggagtgaggtttcatcggttccctcgcactggaggaggcagcggccgcttcggcagcgacagctatggcggtagagacgcgggcagagctggtgggtaagcggttcctgtgtgtggcggtcggcgacgaggcacgttcggagcgctgggagagcggacgcggctggcgaagctggcgagcgggggtcatccgagccgtgtcacacagggacagccgcaatccggacctggcggtgtatgtggaatttgatgatcttgaatgggataaacgagagtgggttaaagtttatgaagatttttcaactttcttggtggaataccacttaatctgggccaaaaggaatgaccctagccagactcagggatcaaagagcaaacagattcagtggcctgcattgactttcaaacctctggttgaaagaaatatacccagttcagtcactgcagtagaattccttgtagataagcaactggattttttaactgaagatagtgcctttcagccctaccaggacgacatagacagcctaaacccagttctcagggacaacccgcagcttcatgaggaagtgaaagtctgggtaaaggaacaaaaggttcaggagatttttatgcaaggtccttattccttaaatggatacagagtgagagtatatagacaagactctgccacccagtggtttactggcataattactcatcatgatctcttcacccgcaccatgatcgttatgaatgatcaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacagccattatacacgtgcccaagcaaatagtcccagaccagcaatgaactcccaagctgctgtaccaaaacagaatacacaccagcaacagcaacaaagaagtatccgtccgaataagaggaagggctcagatagcagtataccagatgaagagaagatgaaggaggaaaaatatgattatatatcacgaggagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcaaaaataaatggagaagaaggaaaaccccataataatgagaaggcaggagaagagaccct

SEQ ID NO: 279752 - DNA, 1321 bp, Homo sapiens
atagcttaaacatgtaattagtatcaccacaaatgagaagaatgaaaggatcacattttccccctcgttttcccttgaagtcatgaacggttggttctgctgtgactttggggcttagttttcagtagaagtgttgtcctgctctgctgctgttactgcgggactgctaattcaggctaactcaggcggcgggcgctgtgtgctctgaacatcaaaccgcgggtgaggcgtcaacccaggagtttattttgtgatcagagtggaaccactacacttcactttcccctcacctccacctctgagggagcaacgaatacaaaggtagacccccaaaagctttgaatagctgtcgcctactttcccgcggccctcttcattttttcgtctcccgctgccgccgccgccgccgcctctggatctggacggacccagtggccgctgccgcctccgcagggccgggcactactttccgtctgcggtggttccgccgaccctcccgcggctgctgccccgcccgcgccggcggaaggagacgcgctgcgcgccgccgctgcccggggagggagacggagcagtactggccgcggcgcggtggcggcggctgggctgcctcggggtcttcgacggccgcgttgggttttgtttcagttttcttgtgtggcgctgcagcacaaggctgcgaatctgggagtccaaaggagtgtttgcggggagggcccgaggtcgctgtgtccggggcagagcggccggttcgtcccgagtctgcgctctttcgggtccgctgctgtgtcccggtccgctctcctcagcatgagcggccggtaggagtgaggtttcatcggttccctcgcactggaggaggcagcggccgcttcggcagcgacagctatggcggtagagacgcgggcagagctggtgggtaagcggttcctgtgtgtggcggtcggcgacgaggcacgttcggagcgctgggagagcggacgcggctggcgaagctggcgagcgggggtcatccgagccgtgtcacacagggacagccgcaatccggacctggcggtaagagagcgagcgccccccttttcccctgccgcgcccgcacccggctctcgcagacgtaccttgcaggcttccctctggcgcctcgctcagcccggccaactggcggtcacgcccctctgccgaacccttggcgcgtttgcccgcatcccttgcctgggtccctgcgtctctccgagcggcttcccctgtggaggtggtgtcggagcaggactcccgggatagccgcggaggctgccctggcccccatcccggaggggtcgac

SEQ ID NO: 279753 - DNA, 1178 bp, Homo sapiens
atagcttaaacatgtaattagtatcaccacaaatgagaagaatgaaaggatcacattttccccctcgttttcccttgaagtcatgaacggttggttctgctgtgactttggggcttagttttcagtagaagtgttgtcctgctctgctgctgttactgcgggactgctaattcaggctaactcaggcggcgggcgctgtgtgctctgaacatcaaaccgcgggtgaggcgtcaacccaggagtttattttgtgatcagagtggaaccactacacttcactttcccctcacctccacctctgagggagcaacgaatacaaaggtagacccccaaaagctttgaatagctgtcgcctactttcccgcggccctcttcattttttcgtctcccgctgccgccgccgccgccgcctctggatctggacggacccagtggccgctgccgcctccgcagggccgggcactactttccgtctgcggtggttccgccgaccctcccgcggctgctgccccgcccgcgccggcggaaggagacgcgctgcgcgccgccgctgcccggggagggagacggagcagtactggccgcggcgcggtggcggcggctgggctgcctcggggtcttcgacggccgcgttgggttttgtttcagttttcttgtgtggcgctgcagcacaaggctgcgaatctgaggtttcatcggttccctcgcactggaggaggcagcggccgcttcggcagcgacagctatggcggtagagacgcgggcagagctggtgggtaagcggttcctgtgtgtggcggtcggcgacgaggcacgttcggagcgctgggagagcggacgcggctggcgaagctggcgagcgggggtcatccgagccgtgtcacacagggacagccgcaatccggacctggcggtaagagagcgagcgccccccttttcccctgccgcgcccgcacccggctctcgcagacgtaccttgcaggcttccctctggcgcctcgctcagcccggccaactggcggtcacgcccctctgccgaacccttggcgcgtttgcccgcatcccttgcctgggtccctgcgtctctccgagcggcttcccctgtggaggtggtgtcggagcaggactcccgggatagccgcggaggctgccctggcccccatcccggaggggtcgac

SEQ ID NO: 279754 - DNA, 1189 bp, Homo sapiens
atcggcacgagggggtttggtgcggccactccaaggccaaagccgcctccttggcctgtagagacgccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggacattggccgagtactgccccgtgctgcgttcgctgcgggtgcggcactgccaccatgtggcggagtccagcctgagccgcttgcggaagcgcggcgtggacatcgacgtggagccgccgctgcaccaggccctggtgctgctgcaggatatggcgggcttcgcaccttttgtcaacctgcaggtctgacccgcctgccaatcggagcacagctggactgtgtggctggggcctgacactgagctgtagggaaactgaactgtgaggacctctggtgagaggccagtgccctgccccaccctggagcttcaaataaagagctttttaccccc

SEQ ID NO: 279755 - DNA, 403 bp, Homo sapiens
cggccgcgccaagcacacggtatgggtgtagactggacccgccccctaaatccaggagaccatcaactatggaaaggagatctagggaacaccgtcttgaacccgccaggggttttgagtctcggacccaggagatccaaccctgaccaccctcccaggatgcagcagggggatgttaaatcagacttcaggaagaacttccttgctgcctgagttaggtgtcgtcacgcctgcccaggggtaagaggttagacgggatgaactagggaccggaagacgtgggggaccggcaacccttgtgcccttggccagggtagaagggggccctgctattttaagaaagagccgctggagttactatggcaactactctctttgggagggccagggcgggcagatggtg

SEQ ID NO: 279756 - DNA, 2215 bp, Homo sapiens
tgtcctcccagctaccccctccctaagcaggctgaggaagaagagatagcaagccctcacctaacttgacccctttcttgtctctccccgctgctagcttctcccttctcgctgccttgcggggtggggaaacgtggaaggaattctgggaaaaccagatgtctgggttctctattcccgtctggcttgattctggacaaggggcttcctctccagggcctcggtttccccatctttaaaatggactgatagcatagacctgcccacctttcagaggtgcccgaagccttgacgagataacagatgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggactctggacctttggaggaaatgaaagggacccagttggaaatatagtctttcttcgcgccccctacatctctctccagcgggggaacgcggcccaaactgttacgaagtggaagaggctggatagctcttcataattaatcaggaatgggaggtttgagcaggtttacttgatgagggaaacattatagcctcgccaattcattcattatttcaacaattacttattgaacacctgctacgtggcagacagtaagagcctggatagtttctccccgtttttcaaagtcgctaaacgcgaccagagggcagaggagaggccggtaacctaagagtcctggctccgccccctccgcgtttggccttgcctgctcctcccaccaccacttcgctcagaggcggctactggctcaagaggacgacagaagccagtctctgatgcccaccgcattctccagcttcaggcctcaagccctgtagccgagaaggcgaggcctaatgttacaccaccggtctgttccgcctccgtttcggggtccacccgaaaagctttcagatcggatcctcggtgagacggcactcgattaaataggtctgtctctacagccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggacattggccgagtactgccccgtgctgcgttcgctgcgggtgcggcactgccaccatgtggcggagtccagcctgagccgcttgcggaagcgcggcgtggacatcgacgtggagccgccgctgcaccaggccctggtgctgctgcaggatatggcgggcttcgcaccttttgtcaacctgcaggtctgacccgcctgccaatcggagcacagctggactgtgtggctggggcctgacactgagctgtagggaaactgaactgtgaggacctctggtgagaggccagtgccctgccccaccctggagcttcaaataaagagctttttaccccc

SEQ ID NO: 279757 - DNA, 1364 bp, Homo sapiens
cggccgcgccaagcacacggtatgggtgtagactggacccgccccctaaatccaggagaccatcaactatggaaaggagatctagggaacaccgtcttgaacccgccaggggttttgagtctcggacccaggagatccaaccctgaccaccctcccaggatgcagcagggggatgttaaatcagacttcaggaagaacttccttgctgcctgagttaggtgtcgtcacgcctgcccaggggccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggacattggccgagtactgccccgtgctgcgttcgctgcgggtgcggcactgccaccatgtggcggagtccagcctgagccgcttgcggaagcgcggcgtggacatcgacgtggagccgccgctgcaccaggccctggtgctgctgcaggatatggcgggcttcgcaccttttgtcaacctgcaggtctgacccgcctgccaatcggagcacagctggactgtgtggctggggcctgacactgagctgtagggaaactgaactgtgaggacctctggtgagaggccagtgccctgccccaccctggagcttcaaataaagagctttttaccccc

SEQ ID NO: 279758 - DNA, 2785 bp, Homo sapiens
cggccgcgccaagcacacggtatgggtgtagactggacccgccccctaaatccaggagaccatcaactatggaaaggagatctagggaacaccgtcttgaacccgccaggggttttgagtctcggacccaggagatccaaccctgaccaccctcccaggatgcagcagggggatgttaaatcagacttcaggaagaacttccttgctgcctgagttaggtgtcgtcacgcctgcccagggcttctcccttctcgctgccttgcggggtggggaaacgtggaaggaattctgggaaaaccagatgtctgggttctctattcccgtctggcttgattctggacaaggggcttcctctccagggcctcggtttccccatctttaaaatggactgatagcatagacctgcccacctttcagaggtgcccgaagccttgacgagataacagatgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggactctggacctttggaggaaatgaaagggacccagttggaaatatagtctttcttcgcgccccctacatctctctccagcgggggaacgcggcccaaactgttacgaagtggaagaggctggatagctcttcataattaatcaggaatgggaggtttgagcaggtttacttgatgagggaaacattatagcctcgccaattcattcattatttcaacaattacttattgaacacctgctacgtggcagacagtaagagcctggatagtttctccccgtttttcaaagtcgctaaacgcgaccagagggcagaggagaggccggtaacctaagagtcctggctccgccccctccgcgtttggccttgcctgctcctcccaccaccacttcgctcagaggcggctactggctcaagaggacgacagaagccagtctctgatgcccaccgcattctccagcttcaggcctcaagccctgtagccgagaaggcgaggcctaatgttacaccaccggtctgttccgcctccgtttcggggtccacccgaaaagctttcagatcggatcctcggtgagacggcactcgattaaataggtctgtctctacagccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggacattggccgagtactgccccgtgctgcgttcgctgcgggtgcggcactgccaccatgtggcggagtccagcctgagccgcttgcggaagcgcggcgtggacatcgacgtggagccgccgctgcaccaggccctggtgctgctgcaggatatggcgggcttcgcaccttttgtcaacctgcaggtctgacccgcctgccaatcggagcacagctggactgtgtggctggggcctgacactgagctgtagggaaactgaactgtgaggacctctggtgagaggccagtgccctgccccaccctggagcttcaaataaagagctttttacccccaaaaaaaaaaaaaaaaaaacaaaaaaaacaaaaaaagaagaagagaaaaaaaaaacgaaaacaagaaacagaaaacaaaacatacagccatcattactcacaacaccaacatacatcaaacacacaacatacatacaactccaatacttctcgtaccccttctcccaccacacacgacgccttctctcgccctatataccaccaccataccactatccaccacctcccttaccctacccccacgcgccacgggcgacacgcgaccgcggggcggccatagcgggcgagggagtcgggcggggcggtggtacgtagtgcctatggctactcgacctcccgtggcgaggccccacagcgcccgaccaccccctctacgcgtgggcatctacctgcccgcggcgcgtggacggagcattcccggacacag

SEQ ID NO: 279759 - DNA, 1610 bp, Homo sapiens
tgtcctcccagctaccccctccctaagcaggctgaggaagaagagatagcaagccctcacctaacttgacccctttcttgtctctccccgctgctagcttctcccttctcgctgccttgcggggtggggaaacgtggaaggaattctgggaaaaccagatgtctgggttctctattcccgtctggcttgattctggacaaggggcttcctctccagggcctcggtttccccatctttaaaatggactgatagcatagacctgcccacctttcagaggtgcccgaagccttgacgagataacagatgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggacattggccgagtactgccccgtgctgcgttcgctgcgggtgcggcactgccaccatgtggcggagtccagcctgagccgcttgcggaagcgcggcgtggacatcgacgtggagccgccgctgcaccaggccctggtgctgctgcaggatatggcgggcttcgcaccttttgtcaacctgcaggtctgacccgcctgccaatcggagcacagctggactgtgtggctggggcctgacactgagctgtagggaaactgaactgtgaggacctctggtgagaggccagtgccctgccccaccctggagcttcaaataaagagctttttaccccc

SEQ ID NO: 279760 - DNA, 2869 bp, Homo sapiens
cggccgcgccaagcacacggtatgggtgtagactggacccgccccctaaatccaggagaccatcaactatggaaaggagatctagggaacaccgtcttgaacccgccaggggttttgagtctcggacccaggagatccaaccctgaccaccctcccaggatgcagcagggggatgttaaatcagacttcaggaagaacttccttgctgcctgagttaggtgtcgtcacgcctgcccagggcttctcccttctcgctgccttgcggggtggggaaacgtggaaggaattctgggaaaaccagatgtctgggttctctattcccgtctggcttgattctggacaaggggcttcctctccagggcctcggtttccccatctttaaaatggactgatagcatagacctgcccacctttcagaggtgcccgaagccttgacgagataacagatgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggactctggacctttggaggaaatgaaagggacccagttggaaatatagtctttcttcgcgccccctacatctctctccagcgggggaacgcggcccaaactgttacgaagtggaagaggctggatagctcttcataattaatcaggaatgggaggtttgagcaggtttacttgatgagggaaacattatagcctcgccaattcattcattatttcaacaattacttattgaacacctgctacgtggcagacagtaagagcctggatagtttctccccgtttttcaaagtcgctaaacgcgaccagagggcagaggagaggccggtaacctaagagtcctggctccgccccctccgcgtttggccttgcctgctcctcccaccaccacttcgctcagaggcggctactggctcaagaggacgacagaagccagtctctgatgcccaccgcattctccagcttcaggcctcaagccctgtagccgagaaggcgaggcctaatgttacaccaccggtctgttccgcctccgtttcggggtccacccgaaaagctttcagatcggatcctcggtgagacggcactcgattaaataggtctgtctctacagccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggtgcctgggcctgatagggcgggaggagggcagtcacttagcctctgctggtatggggcgggctgtagttgttaaaaggccggactgagggttctgaatcttcctgcaaaccacagcacccccattctgaacagaaagggcctctaggattgcctaggccagagagcccatagtttaaaaacttttttcaaccaatgtttacacattgggagatttcacatagaaagtcgacttctggcttttcttcaacaagggggagatcttgcaatcctaggcggagctgagggccaggttccccccttaaatgagacaggaagtctccagctcactggaagccaatccaggcgcctcccttgtgtagggacggaaaaagtatgcccctgccccgagctggagggagaccgggattttgccggagccagtccgaggctgagtgagcccgggcctccaccttaccccaccaaaggtgtggtggcctcatgtccctagcctcaccctgctcctccctcaggacattggccgagtactgccccgtgctgcgttcgctgcgggtgcggcactgccaccatgtggcggagtccagcctgagccgcttgcggaagcgcggcgtggacatcgacgtggagccgccgctgcaccaggccctggtgctgctgcaggatatggcgggcttcgcaccttttgtcaacctgcaggtctgacccgcctgccaatcggagcacagctggactgtgtggctggggcctgacactgagctgtagggaaactgaactgtgaggacctctggtgagaggccagtgccctgccccaccctggagcttcaaataaagagctttttaccccc

SEQ ID NO: 279761 - DNA, 584 bp, Homo sapiens
ggccgagagggaagaggaacctgagggaggggagccgagccggggctgggtctgggggccgctcttgggagctggggcgcaggaacataacggaggcggactcgcaggtaatagtggccccgggacgccagtgccaacgcccctttactcgcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgagccgggggctgaagccccgcccctgcctgggtaccgccccgcctctagcccagcccccagccccgcagtatgcccttctggacccccttgggccgccggggctgcccggaagggatccacgcaccaaagggcaaatactcggtagcgactcagagggaaagtggggtctctcctgggagagcaggaggctgccagaaaagaactcaggtcaggggtgcataggcggctgaggagtgcgggacgggctgagagttggggtgcctccccgcccg

SEQ ID NO: 279762 - DNA, 2358 bp, Homo sapiens
cggccgcgccaagcacacggtatgggtgtagactggacccgccccctaaatccaggagaccatcaactatggaaaggagatctagggaacaccgtcttgaacccgccaggggttttgagtctcggacccaggagatccaaccctgaccaccctcccaggatgcagcagggggatgttaaatcagacttcaggaagaacttccttgctgcctgagttaggtgtcgtcacgcctgcccagggcttctcccttctcgctgccttgcggggtggggaaacgtggaaggaattctgggaaaaccagatgtctgggttctctattcccgtctggcttgattctggacaaggggcttcctctccagggcctcggtttccccatctttaaaatggactgatagcatagacctgcccacctttcagaggtgcccgaagccttgacgagataacagatgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggactctggacctttggaggaaatgaaagggacccagttggaaatatagtctttcttcgcgccccctacatctctctccagcgggggaacgcggcccaaactgttacgaagtggaagaggctggatagctcttcataattaatcaggaatgggaggtttgagcaggtttacttgatgagggaaacattatagcctcgccaattcattcattatttcaacaattacttattgaacacctgctacgtggcagacagtaagagcctggatagtttctccccgtttttcaaagtcgctaaacgcgaccagagggcagaggagaggccggtaacctaagagtcctggctccgccccctccgcgtttggccttgcctgctcctcccaccaccacttcgctcagaggcggctactggctcaagaggacgacagaagccagtctctgatgcccaccgcattctccagcttcaggcctcaagccctgtagccgagaaggcgaggcctaatgttacaccaccggtctgttccgcctccgtttcggggtccacccgaaaagctttcagatcggatcctcggtgagacggcactcgattaaataggtctgtctctacagccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggacattggccgagtactgccccgtgctgcgttcgctgcgggtgcggcactgccaccatgtggcggagtccagcctgagccgcttgcggaagcgcggcgtggacatcgacgtggagccgccgctgcaccaggccctggtgctgctgcaggatatggcgggcttcgcaccttttgtcaacctgcaggtctgacccgcctgccaatcggagcacagctggactgtgtggctggggcctgacactgagctgtagggaaactgaactgtgaggacctctggtgagaggccagtgccctgccccaccctggagcttcaaataaagagctttttaccccc

SEQ ID NO: 279763 - DNA, 2265 bp, Homo sapiens
cggccgcgccaagcacacggtatgggtgtagactggacccgccccctaaatccaggagaccatcaactatggaaaggagatctagggaacaccgtcttgaacccgccaggggttttgagtctcggacccaggagatccaaccctgaccaccctcccaggatgcagcagggggatgttaaatcagacttcaggaagaacttccttgctgcctgagttaggtgtcgtcacgcctgcccagggcttctcccttctcgctgccttgcggggtggggaaacgtggaaggaattctgggaaaaccagatgtctgggttctctattcccgtctggcttgattctggacaaggggcttcctctccagggcctcggtttccccatctttaaaatggactgatagcatagacctgcccacctttcagaggtgcccgaagccttgacgagataacagatgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggactctggacctttggaggaaatgaaagggacccagttggaaatatagtctttcttcgcgccccctacatctctctccagcgggggaacgcggcccaaactgttacgaagtggaagaggctggatagctcttcataattaatcaggaatgggaggtttgagcaggtttacttgatgagggaaacattatagcctcgccaattcattcattatttcaacaattacttattgaacacctgctacgtggcagacagtaagagcctggatagtttctccccgtttttcaaagtcgctaaacgcgaccagagggcagaggagaggccggtaacctaagagtcctggctccgccccctccgcgtttggccttgcctgctcctcccaccaccacttcgctcagaggcggctactggctcaagaggacgacagaagccagtctctgatgcccaccgcattctccagcttcaggcctcaagccctgtagccgagaaggcgaggcctaatgttacaccaccggccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggacattggccgagtactgccccgtgctgcgttcgctgcgggtgcggcactgccaccatgtggcggagtccagcctgagccgcttgcggaagcgcggcgtggacatcgacgtggagccgccgctgcaccaggccctggtgctgctgcaggatatggcgggcttcgcaccttttgtcaacctgcaggtctgacccgcctgccaatcggagcacagctggactgtgtggctggggcctgacactgagctgtagggaaactgaactgtgaggacctctggtgagaggccagtgccctgccccaccctggagcttcaaataaagagctttttaccccc

SEQ ID NO: 279764 - DNA, 2005 bp, Homo sapiens
cggccgcgccaagcacacggtatgggtgtagactggacccgccccctaaatccaggagaccatcaactatggaaaggagatctagggaacaccgtcttgaacccgccaggggttttgagtctcggacccaggagatccaaccctgaccaccctcccaggatgcagcagggggatgttaaatcagacttcaggaagaacttccttgctgcctgagttaggtgtcgtcacgcctgcccagggcttctcccttctcgctgccttgcggggtggggaaacgtggaaggaattctgggaaaaccagatgtctgggttctctattcccgtctggcttgattctggacaaggggcttcctctccagggcctcggtttccccatctttaaaatggactgatagcatagacctgcccacctttcagaggtgcccgaagccttgacgagataacagatgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggactctggacctttggaggaaatgaaagggacccagttggaaatatagtctttcttcgcgccccctacatctctctccagcgggggaacgcggcccaaactgttacgaagtggaagaggctggatagctcttcataattaatcaggaatgggaggtttgagcaggtttacttgatgagggaaacattatagcctcgccaattcattcattatttcaacaattacttattgaacacctgctacgtggcagacagccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggacattggccgagtactgccccgtgctgcgttcgctgcgggtgcggcactgccaccatgtggcggagtccagcctgagccgcttgcggaagcgcggcgtggacatcgacgtggagccgccgctgcaccaggccctggtgctgctgcaggatatggcgggcttcgcaccttttgtcaacctgcaggtctgacccgcctgccaatcggagcacagctggactgtgtggctggggcctgacactgagctgtagggaaactgaactgtgaggacctctggtgagaggccagtgccctgccccaccctggagcttcaaataaagagctttttaccccc

SEQ ID NO: 279765 - DNA, 1147 bp, Homo sapiens
ggccgagagggaagaggaacctgagggaggggagccgagccggggctgggtctgggggccgctcttgggagctggggcgcaggaacataacggaggcggactcgcaggtaatagtggccccgggacgccagtgccaacgcccctttactcgcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggacattggccgagtactgccccgtgctgcgttcgctgcgggtgcggcactgccaccatgtggcggagtccagcctgagccgcttgcggaagcgcggcgtggacatcgacgtggagccgccgctgcaccaggccctggtgctgctgcaggatatggcgggcttcgcaccttttgtcaacctgcaggtctgacccgcctgccaatcggagcacagctggactgtgtggctggggcctgacactgagctgtagggaaactgaactgtgaggacctctggtgagaggccagtgccctgccccaccctggagcttcaaataaagagctttttaccccc

SEQ ID NO: 279766 - DNA, 2407 bp, Homo sapiens
cggccgcgccaagcacacggtatgggtgtagactggacccgccccctaaatccaggagaccatcaactatggaaaggagatctagggaacaccgtcttgaacccgccaggggttttgagtctcggacccaggagatccaaccctgaccaccctcccaggatgcagcagggggatgttaaatcagacttcaggaagaacttccttgctgcctgagttaggtgtcgtcacgcctgcccagggcttctcccttctcgctgccttgcggggtggggaaacgtggaaggaattctgggaaaaccagatgtctgggttctctattcccgtctggcttgattctggacaaggggcttcctctccagggcctcggtttccccatctttaaaatggactgatagcatagacctgcccacctttcagaggtgcccgaagccttgacgagataacagatgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggactctggacctttggaggaaatgaaagggacccagttggaaatatagtctttcttcgcgccccctacatctctctccagcgggggaacgcggcccaaactgttacgaagtggaagaggctggatagctcttcataattaatcaggaatgggaggtttgagcaggtttacttgatgagggaaacattatagcctcgccaattcattcattatttcaacaattacttattgaacacctgctacgtggcagacagtaagagcctggatagtttctccccgtttttcaaagtcgctaaacgcgaccagagggcagaggagaggccggtaacctaagagtcctggctccgccccctccgcgtttggccttgcctgctcctcccaccaccacttcgctcagaggcggctactggctcaagaggacgacagaagccagtctctgatgcccaccgcattctccagcttcaggcctcaagccctgtagccgagaaggcgaggcctaatgttacaccaccggtctgttccgcctccgtttcggggtccacccgaaaagctttcagatcggatcctcggtgagacggcactcgattaaataggtctgtctctacagccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggtgcctgggcctgatagggcgggaggagggcagtcacttagcctctgctggtatggggcgggctgtagttgttaaaaggccggactgagggttctgaatcttcctgcaaaccacagcacccccattctgaacagaaagggcctctaggattgcctaggccagagagcccatagtttaaaaacttttttcaaccaatgtttacacattgggagatttcacatagaaagtcgacttctggcttttcttcaacaagggggagatcttgcaatcctaggcggagctgagggccaatcgttgcaacgatggtcctcagctgaggtgtccaacttgaggtgactgtgaatatgaggcctgaggcagatctaactgctgtgaagaggct

SEQ ID NO: 279767 - DNA, 1066 bp, Homo sapiens
ggttcggacaccggcggcggctgcctggcctttccatgagcccgcggcggaccctcccgcgccccctctcgctctgcctctccctctgcctctgcctctgcctggccgcggctctgggaagtgcgcagtccgggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcagtgtggtgctcaccttgggcacatttttgatgatgggcctcgtccaactgggaaaagatactgcataaattcggctgccttgtcttttacacctgcggatagcagtggcaccgccgagggaggcagtggggtcgccagcccggcccaggcagacaaagcggagctctagagtaatggagagtgatggaaacaaagtgtacttaatgcacagcttattaaaaaaatcaaaattgttatcttaatagatatattttttcaaaaactataagggcagttttgtgctattgatattttttcttcttttgcttaaacagaagccctggccatccatgtattttgcaattgactagatcaagaactgtttatagctttagcaaatggagacagctttgtgaaacttcttcacaagccacttataccctttggcattcttttctttgagcacatggcttcttttgcagtttttccccctttgattcagaagcagagggttcatggtcttcaaacatgaaaatagagatctcctctgcagtgtagagaccagagctgggcagtgcagggcatggagacctgcaagacacatggccttgaggcctttgcacagacccacctaagataagg

SEQ ID NO: 279768 - DNA, 848 bp, Homo sapiens
gaacagtgtaaggattggtatacacagtagttttcagaacaaaggttcatcagtgaaagggaggcatgctgcttgttggaatagagactggagatctattaggtaagtactcctttaaaattctgggaaggttggccttcattccacgatgtgatcaattctgaggcaatcacattcacagatgacttttcctatgggatgcacagggtggaaacaagctgctctcagtgtggtgctcaccttgggcacatttttgatgatgggcctcgtccaactgggaaaagatactgcataaattcggctgccttgtcttttacacctgcggatagcagtggcaccgccgagggaggcagtggggtcgccagcccggcccaggcagacaaagcggagctctagagtaatggagagtgatggaaacaaagtgtacttaatgcacagcttattaaaaaaatcaaaattgttatcttaatagatatattttttcaaaaactataagggcagttttgtgctattgatattttttcttcttttgcttaaacagaagccctggccatccatgtattttgcaattgactagatcaagaactgtttatagctttagcaaatggagacagctttgtgaaacttcttcacaagccacttataccctttggcattcttttctttgagcacatggcttcttttgcagtttttccccctttgattcagaagcagagggttcatggtcttcaaacatgaaaatagagatctcctctgcagtgtagagaccagagctgggcagtgcagggcatggagacctgcaagacacatggccttgaggcctttgcacagacccacctaagataagg

SEQ ID NO: 279769 - DNA, 682 bp, Homo sapiens
ggttcggacaccggcggcggctgcctggcctttccatgagcccgcggcggaccctcccgcgccccctctcgctctgcctctccctctgcctctgcctctgcctggccgcggctctgggaagtgcgcagtccgggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagttcttgtgcctgctgtgtcccaggttggccttcattccacgatgtgatcaattctgaggcaatcacattcacagatgacttttcctatgggatgcacagggtggaaacaagctgctctcagcaagaaggacctcaccagatgctgcccctcaatcttggatttcctggcctccagaactgtgagccaataaatttctattcattctgaattaaccagtctgtggtattctcttatagcagcacaaaatgaactgagacaggtgtgctcactcagtgaaaatgttttgaactgcatgcttatgcttatgaattgttaacttctctgcgtgcatgttacatttcaataaaaaaagtttactcag

SEQ ID NO: 279770 - DNA, 1948 bp, Homo sapiens
cggcggccgcgtcgggaccggccgcgatgggaccggaggcggcgcgggcggcggcggcgcagacaaaggcacgggcggcgtggagggcggcgcggagggcgcgggcccgggagccagggagcgagcggggcgcccggcagcgcggagtcagcgccgcgggggccgcacccgactcgcgcctggacactcgcggggcgccgacctggcagggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcaggctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtgaaaaaaaaaaaaaaaaaaaaaaaaaaaaaaaaaaaaaaaaaaaaggggggggggggaaaaggattttcccggggggggcccacaatttagaggggataacccagtttttttgtacaaggggggcccatatagggggaggatattaaaaggagaagcgaagacggggggggtttaaacagagtgtggagtgggaacaagtgtcatgaggagattggggaaggaaccatcttgggggggtgcacatattgggacacactcatagaaatttaagcttagggaaattaaatttgagggttagggttaacagagatatgtgggtagaaatggcagggatgttggaattgt

SEQ ID NO: 279771 - DNA, 2184 bp, Homo sapiens
aggggtccggacgtcccggacccagggactggaggggtggcagggggtcctcgaagtttaggagtctaggacaacgcggaggaccggggtcccggacccagttagaggaggagtcacgaagggagtccccggagttaccgacctggggttggaggaggcagaagaggtgtcccccgaagttctggacccagagacagggggcgtcgcgggaatctcggaagttccagggtcagagcccgcgtcccggagttggggcgtgcactgggtgtcctgcctcgggtggggatgggatcctgaattaatattaacccccccgtcccccgcactcgggtgcatgggatggggcctcatccaccggccagattggggatcccgggcaccgggcggtgtcggacccccctccgggagccccgtggccggcggcatccgaggcgcatgactagttggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcaggctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtgaaaaaaaaaaaaaaaaaaaaaaaaaaaaaaaaaaaaaaaaaaaaggggggggggggaaaaggattttcccggggggggcccacaatttagaggggataacccagtttttttgtacaaggggggcccatatagggggaggatattaaaaggagaagcgaagacggggggggtttaaacagagtgtggagtgggaacaagtgtcatgaggagattggggaaggaaccatcttgggggggtgcacatattgggacacactcatagaaatttaagcttagggaaattaaatttgagggttagggttaacagagatatgtgggtagaaatggcagggatgttggaattgt

SEQ ID NO: 279772 - DNA, 1814 bp, Homo sapiens
cggcggccgcgtcgggaccggccgcgatgggaccggaggcggcgcgggcggcggcggcgcagacaaaggcacgggcgggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcaggctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtgaaaaaaaaaaaaaaaaaaaaaaaaaaaaaaaaaaaaaaaaaaaaggggggggggggaaaaggattttcccggggggggcccacaatttagaggggataacccagtttttttgtacaaggggggcccatatagggggaggatattaaaaggagaagcgaagacggggggggtttaaacagagtgtggagtgggaacaagtgtcatgaggagattggggaaggaaccatcttgggggggtgcacatattgggacacactcatagaaatttaagcttagggaaattaaatttgagggttagggttaacagagatatgtgggtagaaatggcagggatgttggaattgt

SEQ ID NO: 279773 - DNA, 2427 bp, Homo sapiens
aggggtccggacgtcccggacccagggactggaggggtggcagggggtcctcgaagtttaggagtctaggacaacgcggaggaccggggtcccggacccagttagaggaggagtcacgaagggagtccccggagttaccgacctggggttggaggaggcagaagaggtgtcccccgaagttctggacccagagacagggggcgtcgcgggaatctcggaagttccagggtcagagcccgcgtcccggagttggggcgtgcactgggtgtcctgcctcgggtggggatgggatcctgaattaatattaacccccccgtcccccgcactcgggtgcatgggatggggcctcatccaccggccagattggggatcccgggcaccgggcggtgtcggacccccctccgggagccccgtggccggcggcatccgaggcgcatgactagttggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggtcagggtggggtctgggtggggcagaggcaccaggagtcctggtgacaaccttgggtctggtggctggcttgctgtgtgcccaagggacaggaaaccctaagccttcccaggccctagtctctatctcctgaaagggttcagagtaaagaccttcaagaccctaatacaaggtaatacctggggggtttcatgtttgttagtatctgtcccatctaccttgaactttgttccccgaccctaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcaggctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtgaaaaaaaaaaaaaaaaaaaaaaaaaaaaaaaaaaaaaaaaaaaaggggggggggggaaaaggattttcccggggggggcccacaatttagaggggataacccagtttttttgtacaaggggggcccatatagggggaggatattaaaaggagaagcgaagacggggggggtttaaacagagtgtggagtgggaacaagtgtcatgaggagattggggaaggaaccatcttgggggggtgcacatattgggacacactcatagaaatttaagcttagggaaattaaatttgagggttagggttaacagagatatgtgggtagaaatggcagggatgttggaattgt

SEQ ID NO: 279774 - DNA, 1831 bp, Homo sapiens
aggggtccggacgtcccggacccagggactggaggggtggcagggggtcctcgaagtttaggagtctaggacaacgcggaggaccggggtcccggacccagttagaggaggagtcacgaagggagtccccggagttaccgacctggggttggaggaggcagaagaggtgtcccccgaagttctggacccagagacagggggcgtcgcgggaatctcggaagttccagggtcagagcccgcgtcccggagttggggcgtgcactgggtgtcctgcctcgggtggggatgggatcctgaattaatattaacccccccgtcccccgcactcgggtgcatgggatggggcctcatccaccggccagattggggatcccgggcaccgggcggtgtcggacccccctccgggagccccgtggccggcggcatccgaggcgcatgactagttggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatgcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcaggctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtgaaaaaaaaaaaaaaaaaaaaaaaaaaaaaaaaaaaaaaaaaaaaggggggggggggaaaaggattttcccggggggggcccacaatttagaggggataacccagtttttttgtacaaggggggcccatatagggggaggatattaaaaggagaagcgaagacggggggggtttaaacagagtgtggagtgggaacaagtgtcatgaggagattggggaaggaaccatcttgggggggtgcacatattgggacacactcatagaaatttaagcttagggaaattaaatttgagggttagggttaacagagatatgtgggtagaaatggcagggatgttggaattgt

SEQ ID NO: 279775 - DNA, 1779 bp, Homo sapiens
ggacgaagagaaaaaacgagaaaaaaaaaacaaagccaagggcgagaaggaaaaaagagaaacaagacaagaagagaagagaagacaaagaagaaacaagcaaggagatattttatataggatcgagtgcctggtgttatgtgtcggctatgagggcgtggagggcggcgcggagggcgcgggcccgggagccagggagcgagcggggcgcccggcagcgcggagtcagcgccgcgggggccgcacccgactcgcgcctggacactcgcggggcgccgacctggcagggcggccggaccctgcaagggggggccaaaaccaagtggctctttgcaacctctctggcgttggcccccttaagaggctgggccaatccaagcttgaccaatggttcccacaggcccaaggaggcagcccaaattttctcagccaacaccgggcgcacttttgttcccaaatattgacccccaaggccacgcggcgccaacgaggaagcgcggagcggcggtacaagacaggattggttgggtcgtgaggggccctccggggggggcgacggcgcaacaggggggagacgcgccggaaggttttttccggcactgggcagaggaaccagcaaacccaaacaaaggctgtggaagggcgccctgtgggagagagggccaaggccggcgggaggccccaagtggtgcggccacggcagggttgggagggcgcttccaacgggtgaaagagaggcccgagcggttttgcggcgcacgggggtggctgacgcttggaagggcctcagcggcaagcttcaaaagagttgagccccccacgggtgtgaacaagggacgggcgcttggtgccagggccccggtccgtggaaacccagcttgggaagccctcggggtgcaaccccaggggcccagggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcaggctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtgaaaaaaaaaaaaaaaaaaaaaaaaaaaaaaaaaaaaaaaaaaaaggggggggggggaaaaggattttcccggggggggcccacaatttagaggggataacccagtttttttgtacaaggggggcccatatagggggaggatattaaaaggagaagcgaagacggggggggtttaaacagagtgtggagtgggaacaagtgtcatgaggagattggggaaggaaccatcttgggggggtgcacatattgggacacactcatagaaatttaagcttagggaaattaaatttgagggttagggttaacagagatatgtgggtagaaatggcagggatgttggaattgt

SEQ ID NO: 279776 - DNA, 1442 bp, Homo sapiens
ggacgaagagaaaaaacgagaaaaaaaaaacaaagccaagggcgagaaggaaaaaagagaaacaagacaagaagagaagagaagacaaagaagaaacaagcaaggagatattttatataggatcgagtgcctggtgttatgtgtcggctatgagggcgtggagggcggcgcggagggcgcgggcccgggagccagggagcgagcggggcgcccggcagcgcggagtcagcgccgcgggggccgcacccgactcgcgcctggacactcgcggggcgccgacctggcagggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggtggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtgaaaaaaaaaaaaaaaaaaaaaaaaaaaaaaaaaaaaaaaaaaaaggggggggggggaaaaggattttcccggggggggcccacaatttagaggggataacccagtttttttgtacaaggggggcccatatagggggaggatattaaaaggagaagcgaagacggggggggtttaaacagagtgtggagtgggaacaagtgtcatgaggagattggggaaggaaccatcttgggggggtgcacatattgggacacactcatagaaatttaagcttagggaaattaaatttgagggttagggttaacagagatatgtgggtagaaatggcagggatgttggaattgt

SEQ ID NO: 279777 - DNA, 1506 bp, Homo sapiens
aggggtccggacgtcccggacccagggactggaggggtggcagggggtcctcgaagtttaggagtctaggacaacgcggaggaccggggtcccggacccagttagaggaggagtcacgaagggagtccccggagttaccgacctggggttggaggaggcagaagaggtgtcccccgaagttctggacccagagacagggggcgtcgcgggaatctcggaagttccagggtcagagcccgcgtcccggagttggggcgtgcactgggtgtcctgcctcgggtggggatgggatcctgaattaatattaacccccccgtcccccgcactcgggtgcatgggatggggcctcatccaccggccagattggggatcccgggcaccgggcggtgtcggacccccctccgggagccccgtggccggcggcatccgaggcgcatgactagttggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggtcagggtggggtctgggtggggcagaggcaccaggagtcctggtgacaaccttgggtctggtggctggcttgctgtgtgcccaagggacaggaaaccctaagccttcccaggccctagtctctatctcctgaaagggttcagagtaaagaccttcaagaccctaatacaaggtaatacctggggggtttcatgtttgttagtatctgtcccatctaccttgaactttgttccccgaccctaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcattgtgtagaatttctagatcccccgattacatttctaagcgtgaaaaaaaaaaaaaaaaaaaaaaaaaaaaaaaaaaaaaaaaaaaaggggggggggggaaaaggattttcccggggggggcccacaatttagaggggataacccagtttttttgtacaaggggggcccatatagggggaggatattaaaaggagaagcgaagacggggggggtttaaacagagtgtggagtgggaacaagtgtcatgaggagattggggaaggaaccatcttgggggggtgcacatattgggacacactcatagaaatttaagcttagggaaattaaatttgagggttagggttaacagagatatgtgggtagaaatggcagggatgttggaattgt

SEQ ID NO: 279778 - DNA, 2026 bp, Homo sapiens
ggacgaagagaaaaaacgagaaaaaaaaaacaaagccaagggcgagaaggaaaaaagagaaacaagacaagaagagaagagaagacaaagaagaaacaagcaaggagatattttatataggatcgagtgcctggtgttatgtgtcggctatgagggcgtggagggcggcgcggagggcgcgggcccgggagccagggagcgagcggggcgcccggcagcgcggagtcagcgccgcgggggccgcacccgactcgcgcctggacactcgcggggcgccgacctggcagggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcaggctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtgaaaaaaaaaaaaaaaaaaaaaaaaaaaaaaaaaaaaaaaaaaaaggggggggggggaaaaggattttcccggggggggcccacaatttagaggggataacccagtttttttgtacaaggggggcccatatagggggaggatattaaaaggagaagcgaagacggggggggtttaaacagagtgtggagtgggaacaagtgtcatgaggagattggggaaggaaccatcttgggggggtgcacatattgggacacactcatagaaatttaagcttagggaaattaaatttgagggttagggttaacagagatatgtgggtagaaatggcagggatgttggaattgt

SEQ ID NO: 279779 - DNA, 1850 bp, Homo sapiens
ttgattgaaagttccatgacgggcacacctggtgatgggtcctgagatggaacctgcttggcctccctcagcctggcctgagggacactcatagtccctcctctctccctaggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcaggctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtgaaaaaaaaaaaaaaaaaaaaaaaaaaaaaaaaaaaaaaaaaaaaggggggggggggaaaaggattttcccggggggggcccacaatttagaggggataacccagtttttttgtacaaggggggcccatatagggggaggatattaaaaggagaagcgaagacggggggggtttaaacagagtgtggagtgggaacaagtgtcatgaggagattggggaaggaaccatcttgggggggtgcacatattgggacacactcatagaaatttaagcttagggaaattaaatttgagggttagggttaacagagatatgtgggtagaaatggcagggatgttggaattgt

SEQ ID NO: 279780 - DNA, 2076 bp, Homo sapiens
aggggtccggacgtcccggacccagggactggaggggtggcagggggtcctcgaagtttaggagtctaggacaacgcggaggaccggggtcccggacccagttagaggaggagtcacgaagggagtccccggagttaccgacctggggttggaggaggcagaagaggtgtcccccgaagttctggacccagagacagggggcgtcgcgggaatctcggaagttccagggtcagagcccgcgtcccggagttggggcgtgcactgggtgtcctgcctcgggtggggatgggatcctgaattaatattaacccccccgtcccccgcactcgggtgcatgggatggggcctcatccaccggccagattggggatcccgggcaccgggcggtgtcggacccccctccgggagccccgtggccggcggcatccgaggcgcatgactagttggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcaggctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtgaaaaaaaaaaaaaaaaaaaaaaaaaaaaaaaaaaaaaaaaaaaaggggggggggggaaaaggattttcccggggggggcccacaatttagaggggataacccagtttttttgtacaaggggggcccatatagggggaggatattaaaaggagaagcgaagacggggggggtttaaacagagtgtggagtgggaacaagtgtcatgaggagattggggaaggaaccatcttgggggggtgcacatattgggacacactcatagaaatttaagcttagggaaattaaatttgagggttagggttaacagagatatgtgggtagaaatggcagggatgttggaattgt

SEQ ID NO: 279781 - DNA, 1322 bp, Homo sapiens
aggggtccggacgtcccggacccagggactggaggggtggcagggggtcctcgaagtttaggagtctaggacaacgcggaggaccggggtcccggacccagttagaggaggagtcacgaagggagtccccggagttaccgacctggggttggaggaggcagaagaggtgtcccccgaagttctggacccagagacagggggcgtcgcgggaatctcggaagttccagggtcagagcccgcgtcccggagttggggcgtgcactgggtgtcctgcctcgggtggggatgggatcctgaattaatattaacccccccgtcccccgcactcgggtgcatgggatggggcctcatccaccggccagattggggatcccgggcaccgggcggtgtcggacccccctccgggagccccgtggccggcggcatccgaggcgcatgactagttggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatgctggggtgggccccagtcggctctggttgttggcagctttggggctgtttttgagcttctcattgtgtagaatttctagatcccccgattacatttctaagcgtgaaaaaaaaaaaaaaaaaaaaaaaaaaaaaaaaaaaaaaaaaaaaggggggggggggaaaaggattttcccggggggggcccacaatttagaggggataacccagtttttttgtacaaggggggcccatatagggggaggatattaaaaggagaagcgaagacggggggggtttaaacagagtgtggagtgggaacaagtgtcatgaggagattggggaaggaaccatcttgggggggtgcacatattgggacacactcatagaaatttaagcttagggaaattaaatttgagggttagggttaacagagatatgtgggtagaaatggcagggatgttggaattgt

SEQ ID NO: 279782 - DNA, 383 bp, Homo sapiens
taggcccctgtggggtgtgcattttattcctggtgtgttgggcgccctaggatggctctgggcagaagagggacatgaaggtggtcagactctggatgcctcgggcaggactggtgatttgttggggcccccaaccctgcccaccctttcctggcaggacctggagacccgcaatgcggagttggagcaccagctgcgggcgatggagcgcagcctggaggaggcacgggcagagcgggagcgggcgcgggctgaggtgggccgggcagcgcagctgctggacgtcaggctgtttgagctgagtgagctgcgtgagggcctggcccgcctggctgaggctgcgccctgagccggggctggttttctatgaacgattccggcct

SEQ ID NO: 279783 - DNA, 696 bp, Homo sapiens
ggtgaactttggaataattttcttctcaccaataataattggatattctggctcggtgcagtggttcatgcttgtaatcccagcactttgaggggccaaggcaggaggatcgcttgaagccaggcgttcaagaccagcctgggcaacacagacctcatttctaccaaaaaaaccacaaaaagttagctggactggtggtacatgcctatagtcctagctattcaggaggctgaggtgggaggatgccttgagcctaggagttcaaggttacattgagctatgattacactactgcactccagcctgggtgacagagcaagaccccatctcaaatcataatgatgatgagtggatattttctcagtagctgtggagacaggatgattgatagcaagagtgcctgctctaactaaagcacctttctcaagcttttttaaaaaaactatctttgtggaaaaattcaaaagtatctgtttttattgccattttctcagatgcgtcttttttggtggtgacagagtaactatcacctgggcttaagaaatgaagatgttcttgttgtttcctaagactcctcggttcagttttactggtatggaatcctaagggtaaatcaatacactattttaaagggaaagattaaattcttaatctctaagaaaacaaattttgtataaaacaagagccaaagaactg

SEQ ID NO: 279784 - DNA, 1577 bp, Homo sapiens
gccctatctctttgaacaagttgccaaggatctagccaagaaagaagcagaacagtggtatctagacaccctgaagcaggctgggctggaggaagactttgtgagaaacaagggtcaaggcacccgggctgttcaagagaaagagaccaaaatcaaggattttcccaggttccaagaaactacaaaactcagcatcagagatccagagcagggtttagaaggatctctagaacagcctgcaagccccaggaaagtactggaggagctgtctcatcagtcaccagaaaatctcgtatcacttgcttaatcactacacttaaaattactgcttttgaaaaatattaagcagctaacttgggtttgagtcaaggcagggaaaacttgggttttgagtcatggctactgttagaggatggacaaatgaagagtagcagattaacaggccaggcgcagtggctcacgcctgtaatcccaacactttgggaggctgaggcaggcagatcatctgaggtcaggagtttgagaccagtccagccaacacggcaaaactccacctctactaaaaatacaaaaattagctgggcgtgatgacacgtgcctgtaatcctagctacttgggaagctgaggcaggagaatcacttgaacccaagaggcagaggttgtaatgagctgagatcactccacagcactccagcctgggcagcagagcaaaactctgtctgagaaaaaaaaagagcagcagataacagagaatagttcaaggaaatcaaagtggggaggctcaggtggagggatggtagcctaaagttaagggttcctgctttgtgcctcacacttagagaattaggtacagaaaagagagcacaggcccaaatgcctataaggggctagtgcagaaacataaatgcgtccatggagtgggtgtagacagtaggagatagtagacactggaaagtatcaaatcctgctggaatataggctcagagttactacatcaactacattttcatcaagccagaaatttgtatgctatcaactaatttaaaaattacttagaaatattgtatgggcaaaataaaatacatctgcatatcagatctagcccatgggggatgaaaaacttacaacttctagtacaggatttcttatcctcagtgctattaatattttgggccacctaattctttgttgagggttggggaagggaactgtcctgtacattgtagaatgtttagtagcatccctggccactacctgctagatgccagtagtacccctctccccagctgtgacaaccaaaaatgtctccagatattgcatatccccagggggcaaaaatgtgcctggctgagaaccactgctctaatataaatggctgcatgaagcaaaaactggcattctaagaatacaagtaattgccatgaacacagtctatgtactatgtgattatgcatgtcattaacaaattaagaatttaaaacaattctctcccgttatctgtttagaatgtgcctgtgtgtttatgtgagcatgaggttcattttaagtaaacttaaaatttcccagacaaccaaga

SEQ ID NO: 279785 - DNA, 451 bp, Homo sapiens
gccctatctctttgaacaagttgccaaggatctagccaagaaagaagcagaacagtggtatctagacaccctgaagcaggctgggctggaggaagactttgtgagaaacaagggtcaaggcacccgggctgttcaagagaaagagaccaaaatcaaggattttcccaggttccaagaaactacaaaactcagcatcagagatccagagcagggtttagaaggatctctagaacagcctgcaagccccagatgcgtcttttttggtggtgacagagtaactatcacctgggcttaagaaatgaagatgttcttgttgtttcctaagactcctcggttcagttttactggtatggaatcctaagggtaaatcaatacactattttaaagggaaagattaaattcttaatctctaagaaaacaaattttgtataaaacaagagccaaagaactg

SEQ ID NO: 279786 - DNA, 1617 bp, Homo sapiens
gccctatctctttgaacaagttgccaaggatctagccaagaaagaagcagaacagtggtatctagacaccctgaagcaggctgggctggaggaagactttgtgagaaacaagggtcaaggcacccgggctgttcaagagaaagagaccaaaatcaaggattttcccaggttccaagaaactacaaaactcagcatcagagatccagagcagggtttagaaggatctctagaacagcctgcaagccccaggaaagtactggaggagctgtctcatcagtcaccagaaaatctcgtatcacttgcttaatcactacacttaaaattactgcttttgaaaaatattaagcagctaacttgggtttgagtcaaggcagggaaaacttgggttttgagtcatggctactgttagaggatggacaaatgaagagtagcagattaacaggccaggcgcagtggctcacgcctgtaatcccaacactttgggaggctgaggcaggcagatcatctgaggtcaggagtttgagaccagtccagccaacacggcaaaactccacctctactaaaaatacaaaaattagctgggcgtgatgacacgtgcctgtaatcctagctacttgggaagctgaggcaggagaatcacttgaacccaagaggcagaggttgtaatgagctgagatcactccacagcactccagcctgggcagcagagcaaaactctgtctgagaaaaaaaaagagcagcagataacagagaatagttcaaggaaatcaaagtggggaggctcaggtggagggatggtagcctaaagttaagggttcctgctttgtgcctcacacttagagaattaggtacagaaaagagagcacaggcccaaatgcctataaggggctagtgcagaaacataaatgcgtccatggagtgggtgtagacagtaggagatagtagacactggaaagtatcaaatcctgctggaatataggctcagagttactacatcaactacattttcatcaagccagaaatttgtatgctatcaactaatttaaaaattacttagaaatattgtatgggcaaaataaaatacatctgcatatcagatctagcccatggggggaacttgaacaacaaacccttttaacacagcgtctccctaagcgtaaccagcggaatctctcgtctacatcccatccagggtgtgctattaatattttgggccacctaattctttgttgagggttggggaagggaactgtcctgtacattgtagaatgtttagtagcatccctggccactacctgctagatgccagtagtacccctctccccagctgtgacaaccaaaaatgtctccagatattgcatatccccagggggcaaaaatgtgcctggctgagaaccactgctctaatataaatggctgcatgaagcaaaaactggcattctaagaatacaagtaattgccatgaacacagtctatgtactatgtgattatgcatgtcattaacaaattaagaatttaaaacaattctctcccgttatctgtttagaatgtgcctgtgtgtttatgtgagcatgaggttcattttaagtaaacttaaaatttcccagacaaccaaga

SEQ ID NO: 279787 - DNA, 325 bp, Homo sapiens
ccaacttacagatgagtaaactgaaacatgaagtgaaatgacatctcaaggacagcagagagtgtgtacaggagccaggaggcctaggggctgaggttgggcgtggggtttgtggaaagtggcctctccaagtctctttcaactctgacattctggggatgaagatccggtaagcagctcatcacagagaaacctacagcccggtacccagaccgccccacctgccatcaagaatcaacaccacgcactccacccccaccactcccagccctgagaggggctctggccagccccgcaggtctcacctgctctaggccggatgggc

SEQ ID NO: 279788 - DNA, 230 bp, Homo sapiens
tccctgtcggctagctcgggtctggcccacggtgactgttacccctggggaatggggcagctctgatccatccaacgctgctgcactggagactgggtcagaaatcaggagtgaggacttgttgaaagaaataggaaggaatcagatcacataaatgctggccccaaatgtttgcatcataaacccattgcctaattttacagttgagaaaataaagctctctaaataac

SEQ ID NO: 279789 - DNA, 1734 bp, Homo sapiens
tattaataggatttattagttcaaattctttattaggatatgctaacaatgagactattatgatgaacccccacattttaaaccataggtttttatacaagtagcagtatcaaatttattgtaatattttactttgcacaaatcaaggaaatcctgattgaatctaggtagttacaaatggttttttaataattcactttgtactgtccagatattctttaattaaaatatccaaaattagaagaccagtagggcttttgtttcaaaagctaacaatacccaactactgcttgctttccttattatagacaaggcatgtgaggaacacctagacgtttttaaagccccaaaactaggatattgtgacacagaatgttttttattcagtgctgagatgggagtttatcccaagcgactgtcctggcccctcatacaattatagtggtgaccagtcaggggctgtgggtgaggagacctgccagaggtggctggaggcactttattgccagcctggcgggctggcgaaggcgccaatgaagtaaaatctggtgacacacttgagtttgcatgcggcattttattttattggttttttttaaaggaagagattataaaaagacatttcacattaaagatttgcagtcctgggacacagtttggaaaacactatttataaggttgcacatattacaaacagctcccaaatggtgaaactggtattctaagatgaaagcttaatgaacataatgaagtgaataaacgcgtgtgaactaatgtttaaaaagttagagcttgtctcaagtcagtacagctcttaagataataaatacagtaacactactttttatttctttgctcttttatccctttcaggttcgatttgctgctttgattactgtgttagcactggctgaaaaactaaaggagaattatattgtcttgctaccagaatccattcctttcttagcagagttgatggaaggtaattcccaaactattcccaaccattaaacaattaaggaataattcagtaaaattctgtgaaaatgtgcccaatgataatgcagatttggatataacgtgactagcagttgatccagtcctcatacaggcagctccagtctcaaatacaggcaggctcgagctcctgttttgagttgggtggagggagcaagttgcgaagtgaccacctcctgatcatttgagagtccgtttacagtgtaatcttcacgatcttttcttttgtggtggtttgtgatcatacaagcagattacagtagtgtttttaattaacctcatacatttatatgattgaagttttggtccccagattgtatggaaatgcctagtggcattaaggatgcggtaggatgtccacttttagtagcaaccgatgttcattcactactccatgttaggtgctttacttggattatctcacttaaaaaccacaacattttatctctgttttacaaaggaagaaactagaggcttaaaagatttcagttatttgacaaagatcacaagctagtgggtgtgacatggggagctgtgacagttctggaacataagtcttaggcccaggaaataacagtaaatgttattattaagggaggggtggtggagcaagtagatcagtcctttactgattcattgcttatctaagctacaaaagtacattctcctttgtttcttagctcttggaggggggaggtgtgagctactaaagcggtg

SEQ ID NO: 279790 - DNA, 3004 bp, Homo sapiens
tattggtgccaactctttttaacttgctatcaagatgtttagaacccttgccacaagagcagggaaatatggaatacaccaaacaattaattcttagttgtctgctcaacatctgccaaaaactatctccagatggtggcaaaatacccaaagatattttagatgaggagaagttcaacgtggagttgatagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggcggctgcctatggcgaaaaggatgctattttagaagcagacactgaatttcggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcagtgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcgttgtataccttaaagcttttatgcaagaattttggtgcagaaaatccagatccttttgtcccagtgctgagcactgctgtgaaactgattgctccagagagaaaggaggagaagaatgtcttgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggtgatgaagaaggaagagctcacctcccatcagtctcagctaaccgcctttttcctggaggccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttggaccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcaggagccttgatgatgcctctggtggatcagctggaaaacaggcttgggggagaagagaaattccaggaacgggtgacaaagcacctgataccatgcatcgcacagttttcagtggccatggcggatgactctctttggaaaccactgaactaccagattctgctaaagacgagagactcctcgcctaaggttcgatttgctgctttgattactgtgttagcactggctgaaaaactaaaggagaattatattgtcttgctaccagaatccattcctttcttagcagagttgatggaagatgaatgtgaagaagtagaacatcagtgccaaaagactattcagcaactggaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttcgttacaaaatccccacctggcttgtgctgccacataagcctctcctgcctatcgtatagagctgcagaaagagtaaatgatacacggtatttttatacagactgc

SEQ ID NO: 279791 - DNA, 458 bp, Homo sapiens
catggagaaagaccctgtctctaaaaaaataaataaaattcttctggcaatttcttggggcccatctaaaagccttatcttgttcacctaaacttgttttgtggaagattacttgcacctactcattgtctctgcttgctgttttgcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggcggctgcctatggcgaaaaggtcagaacctagggtgggaagataaggaaaatggtgatttctcacacagattttatgatattgtccagtttaaacatg

SEQ ID NO: 279792 - DNA, 3371 bp, Homo sapiens
tattggtgccaactctttttaacttgctatcaagatgtttagaacccttgccacaagagcagggaaatatggaatacaccaaacaattaattcttagttgtctgctcaacatctgccaaaaactatctccagatggtggcaaaatacccaaagatattttagatgaggagaagttcaacgtggagttgatagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggcggctgcctatggcgaaaaggatgctattttagaagcagacactgaatttcggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcagtgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcgttgtataccttaaagcttttatgcaagaattttggtgcagaaaatccagatccttttgtcccagtgctgagcactgctgtgaaactgattgctccagagagaaaggaggagaagaatgtcttgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggtgatgaagaaggaagagctcacctcccatcagtctcagctaaccgcctttttcctggaggccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttggaccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcaggagccttgatgatgcctctggtggatcagctggaaaacaggcttgggggagaagagaaattccaggaacgggtgacaaagcacctgataccatgcatcgcacagttttcagtggccatggcggatgactctctttggaaaccactgaactaccagattctgctaaagacgagagactcctcgcctaaggttcgatttgctgctttgattactgtgttagcactggctgaaaaactaaaggagaattatattgtcttgctaccagaatccattcctttcttagcagagttgatggaaggtaattcccaaactattcccaaccattaaacaattaaggaataattcagtaaaattctgtgaaaatgtgcccaatgataatgcagatttggatataacgtgactagcagttgatccatgagttgggtggagggagcaagttgcgaagtgaccacctcctgatcatttgagagtccgtttacagtgtaatcttcacgatcttttcttttgtggtggtttgtgatcatacaagcagattacagtagtgtttttaattaacctcatacatttatatgattgaagttttggtccccagattgtatggaaatgcctagtggcattaaggatgcggtaggatgtccacttttagtagcaaccgatgttcattcactactccatgttaggtgctttacttggattatctcacttaaaaaccacaacattttatctctgttttacaaaggaagaaactagaggcttaaaagatttcagttatttgacaaagatcacaagctagtgggtgtgacatggggagctgtgacagttctggaacataagtcttaggcccaggaaataacagtaaatgttattattaagggaggggtggtggagcaagtagatcagtcctttactgattcattgcttatctaagctacaaaagtacattctcctttgtttcttagctcttggaggggggaggtgtgagctactaaagcggtg

SEQ ID NO: 279793 - DNA, 1519 bp, Homo sapiens
tattggtgccaactctttttaacttgctatcaagatgtttagaacccttgccacaagagcagggaaatatggaatacaccaaacaattaattcttagttgtctgctcaacatctgccaaaaactatctccagatggtggcaaaatacccaaagatattttagatgaggagaagttcaacgtggagttgatagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggcggctgcctatggcgaaaaggatgctattttagaagcagacactgaatttcggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcagtgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagactatttctaagactttctgtggtgtttcatactctactcagagttcacactcatatttcatatttttatttttgggtgttgggtgccatgttacttttggtgccttaatacacctacttggattacttacaaatgttttatcacttcgttacaaaatccccacctggcttgtgctgccacataagcctctcctgcctatcgtatagagctgcagaaagagtaaatgatacacggtatttttatacagactgc

SEQ ID NO: 279794 - DNA, 566 bp, Homo sapiens
tgcacacgatagagcacttgggtcatagaaagcactgagctcattcgggttgaaagtcatccactagttatcctcttgtgccctttaacttttctaaggccaaggggaaggacttccaagcacgggcagctggaactccagggctgtcagagccaccgcgggcaccttcacaaacagcgggttaacatcccaaccctatacaggcaagcccgccctggggacagcaaacgagtggggaagcacatccttttcactggactgaagcagccaatttcccttccgcgacaaacttggccacttacaaagaagagagaaaacggagcaagctgcagcaaaaataaacggtgaagcgcgacgatgccggccaagaagacccccagttacttaccggcctgcttaccagccattttgaccagaaagagaagcgttgccttctggactggcaacactccagaaatgatggagacaggatacatcaacctgtatcactgaagatgatgtggagcagagcctttgtggtcctaagaaacatgtataagataaaaacttttgtggtttttcaatca

SEQ ID NO: 279795 - DNA, 685 bp, Homo sapiens
tgcacacgatagagcacttgggtcatagaaagcactgagctcattcgggttgaaagtcatccactagttatcctcttgtgccctttaacttttctaaggccaaggggaaggacttccaagcacgggcagctggaactccagggctgtcagagccaccgcgggcaccttcacaaacagcgggttaacatcccaaccctatacaggcaagcccgccctggggacagcaaacgagtggggaagcacatccttttcactggactgaagcagccaatttcccttccgcgacaaacttggccacttacaaagaagagagaaaacggagcaagctgcagcaaaaataaacggtgaagcgcgacgatgccggccaagaagacccccagttacttaccggcctgcttaccagccattttgaccagaaagagaagcgttgccttctggtcagtcctgtatacagcactaaagctgatgaatgatctatcttacactagccaaagtgaagtctgaaagatgtgaagaaatgcagtacatttgtacattggcacattgccctgcagaggactggcaacactccagaaatgatggagacaggatacatcaacctgtatcactgaagatgatgtggagcagagcctttgtggtcctaagaaacatgtataagataaaaacttttgtggtttttcaatca

SEQ ID NO: 279796 - DNA, 591 bp, Homo sapiens
  misc_feature (7)..(7): n is a, c, g, or t
  misc_feature (22)..(22): n is a, c, g, or t
  misc_feature (62)..(62): n is a, c, g, or t
  misc_feature (84)..(84): n is a, c, g, or t
  misc_feature (96)..(96): n is a, c, g, or t
  misc_feature (111)..(111): n is a, c, g, or t
cagaaangccctgaggtcctgnccagtgtgttcaaacctccggcatcccagccttttcactntggggacgcaagccaggtcctngcctgggcgttnttactctcctcaccnccgaaagccaggaactgagccgatatttaaataaggcttttcatatcgggccaagaaagaaaaattctcacccacttttataacccaatgtaatatctcacacgggcctggcactcaccttctattctgtatgatgtatttggttaaacactgtcaaataatagagatgtgccagatttagattttcttaccctaatctgtttaatattgtaactttattccatttgaaagtgtcaagcccattcagataagctataatctggtctttaaggaacacaactttaaaactgcagctttcttttatataaatcaagcctctgttaacttgaattccttatagtacatattttcccatctgtaatgacgaaattttgattctaatattttttctattatttataagtgcaaattttttaaaaaagtgtacagctttctaaaagtaataaaggtttagcataaatacagacttccagtagtcaa

SEQ ID NO: 279797 - DNA, 1861 bp, Homo sapiens
tgttcttccaacacttcattgaatgtatttttcactttaataactatgagaagcatgagaagtacaacaagttcccccagtcagagagagagaagcggctgttttcattgaagggaaagtcaaacaaagagagacgaatgaaaatctacaaatttcttctagagcacttcacagatgaacagcgattcaacatcacttccaaaatctgccttagtattttggcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaagagcaggcatcggagtcggagcttaggagtgctgcctttcactttaaattctggaagcccagaaaaaacgtgcagtcaggtgtcttcatacagtttggagcaagagtcgaatggcgagattgagcacgtgaccaagcgggccatcagcacccccgagaagagcatcagtgatgtcacgtttggagcaggggtcagttacatcgggacaccacggactccgtcgtcagccaaagagaaaattgaaggccggagtcaaggaaatgacatcttatgtttatcactgcctgataaaccgcccccacagcctcagcagtggaatgtgcggtctcccgccaggaataaagacactccagcctgcagcaggaggtccctccgaaagacccctctgaaaacagccaactaaacagcgcctcccaccagtgtccaggcaggcaggagcccttgaggaagcagtctcgtgtcctccgtgtgaaggcagctggatcacttcccgcagtccttgggcagcgctttgctgtggaacacgagagctcctcctcaggggcctggcactcaccttctattctgtatgatgtatttggttaaacactgtcaaataatagagatgtgccagatttagattttcttaccctaatctgtttaatattgtaactttattccatttgaaagtgtcaagcccattcagataagctataatctggtctttaaggaacacaactttaaaactgcagctttcttttatataaatcaagcctctgttaacttgaattccttatagtacatattttcccatctgtaatgacgaaattttgattctaatattttttctattatttataagtgcaaattttttaaaaaagtgtacagctttctaaaagtaataaaggtttagcataaatacagacttccagtagtcaa

SEQ ID NO: 279798 - DNA, 1928 bp, Homo sapiens
tgttcttccaacacttcattgaatgtatttttcactttaataactatgagaagcatgagaagtacaacaagttcccccagtcagagagagagaagcggctgttttcattgaagggaaagtcaaacaaagagagacgaatgaaaatctacaaatttcttctagagcacttcacagatgaacagcgattcaacatcacttccaaaatctgccttagtattttggcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaagagcaggcatcggagtcggagcttaggagtgctgcctttcactttaaattctggaagcccagaaaaaacgtgcagtcaggtgtcttcatacagtttggagcaagagtcgaatggcgagattgagcacgtgaccaagcgggccatcagcacccccgagatgtcgttacattcagtcagtcaaacaccacagtggcccgcggagcagacaatgccgttgaggcacagagagcatcagtgatgtcacgtttggagcaggggtcagttacatcgggacaccacggactccgtcgtcagccaaagagaaaattgaaggccggagtcaaggaaatgacatcttatgtttatcactgcctgataaaccgcccccacagcctcagcagtggaatgtgcggtctcccgccaggaataaagacactccagcctgcagcaggaggtccctccgaaagacccctctgaaaacagccaactaaacagcgcctcccaccagtgtccaggcaggcaggagcccttgaggaagcagtctcgtgtcctccgtgtgaaggcagctggatcacttcccgcagtccttgggcagcgctttgctgtggaacacgagagctcctcctcaggggcctggcactcaccttctattctgtatgatgtatttggttaaacactgtcaaataatagagatgtgccagatttagattttcttaccctaatctgtttaatattgtaactttattccatttgaaagtgtcaagcccattcagataagctataatctggtctttaaggaacacaactttaaaactgcagctttcttttatataaatcaagcctctgttaacttgaattccttatagtacatattttcccatctgtaatgacgaaattttgattctaatattttttctattatttataagtgcaaattttttaaaaaagtgtacagctttctaaaagtaataaaggtttagcataaatacagacttccagtagtcaa

SEQ ID NO: 279799 - DNA, 1495 bp, Homo sapiens
tcgaattacagattgagcacataccagaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaagagcaggcatcggagtcggagcttaggagtgctgcctttcactttaaattctggaagcccagaaaaaacgtgcagtcaggtgtcttcatacagtttggagcaagagtcgaatggcgagattgagcacgtgaccaagcgggccatcagcacccccgagaagagcatcagtgatgtcacgtttggagcaggggtcagttacatcgggacaccacggactccgtcgtcagccaaagagaaaattgaaggccggagtcaaggaaatgacatcttatgtttatcactgcctgataaaccgcccccacagcctcagcagtggaatgtgcggtctcccgccaggaataaagacactccagcctgcagcaggaggtccctccgaaagacccctctgaaaacagccaactaaacagcgcctcccaccagtgtccaggcaggcaggagcccttgaggaagcagtctcgtgtcctccgtgtgaaggcagctggatcacttcccgcagtccttgggcagcgctttgctgtggaacacgagagctcctcctcaggggcctggcactcaccttctattctgtatgatgtatttggttaaacactgtcaaataatagagatgtgccagatttagattttcttaccctaatctgtttaatattgtaactttattccatttgaaagtgtcaagcccattcagataagctataatctggtctttaaggaacacaactttaaaactgcagctttcttttatataaatcaagcctctgttaacttgaattccttatagtacatattttcccatctgtaatgacgaaattttgattctaatattttttctattatttataagtgcaaattttttaaaaaagtgtacagctttctaaaagtaataaaggtttagcataaatacagacttccagtagtcaa

SEQ ID NO: 279800 - DNA, 492 bp, Homo sapiens
tgatcgaggccggtaccgaattacgctcctagacggctccgtgtgaaggcagctggatcacttcccgcagtccttgggcagcgctttgctgtggaacacgagagctcctcctcaggggcctggcactcaccttctattctgtatgatgtatttggttaaacactgtcaaataatagagatgtgccagatttagattttcttaccctaatctgtttaatattgtaactttattccatttgaaagtgtcaagcccattcagataagctataatctggtctttaaggaacacaactttaaaactgcagctttcttttatataaatcaagcctctgttaacttgaattccttatagtacatattttcccatctgtaatgacgaaattttgattctaatattttttctattatttataagtgcaaattttttaaaaaagtgtacagctttctaaaagtaataaaggtttagcataaatacagacttccagtagtcaa

SEQ ID NO: 279801 - DNA, 1244 bp, Homo sapiens
tgttcttccaacacttcattgaatgtatttttcactttaataactatgagaagcatgagaagtacaacaagttcccccagtcagagagagagaagcggctgttttcattgaagggaaagtcaaacaaagagagacgaatgaaaatctacaaatttcttctagagcacttcacagatgaacagcgattcaacatcacttccaaaatctgccttagtattttggcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaagagcaggcatcggagtcggagcttaggagtgctgcctttcactttaaattctggaagcccagaaaaaacgtgcagtcaggtgtcttcatacagtttggagcaagagtcgaatggcgagattgagcacgtgaccaagcgggccatcagcacccccgagagtgagtaactgatcggaacacgtgggcttctcctcagtctctcctgcattcgtgatgtgtttgctagagtcgcagtaaaactccttccggtgcaggatagttctgatggtcagaaccatgagtgcattgctgaggtggagtat

SEQ ID NO: 279802 - DNA, 1993 bp, Homo sapiens
acgagccggtcaatagtacggcgcagtgtgtggaattcggttacgggaacatcacttccaaaatctgccttagtattttgggtaagcccagtgtgtgtgggagaaaatgtgtgtgtttgcaaatgaaatgctgtgttgataatggcccagcaggcctctagtaagggagaccctggcactgcaggaagacccctgtcatcttgtccttctctggcatcagctgtgccccagacaaaacacccttgcagaccccctgacagcctcagatggccccccagttgtgggaattacacctcctctctgggccagagcatttctcagaagctcacgtttttctctctctctgtctctcagcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaagagcaggcatcggagtcggagcttaggagtgctgcctttcactttaaattctggaagcccagaaaaaacgtgcagtcaggtgtcttcatacagtttggagcaagagtcgaatggcgagattgagcacgtgaccaagcgggccatcagcacccccgagaagagcatcagtgatgtcacgtttggagcaggggtcagttacatcgggacaccacggactccgtcgtcagccaaagagaaaattgaaggccggagtcaaggaaatgacatcttatgtttatcactgcctgataaaccgcccccacagcctcagcagtggaatgtgcggtctcccgccaggaataaagacactccagcctgcagcaggaggtccctccgaaagacccctctgaaaacagccaactaaacagcgcctcccaccagtgtccaggcaggcaggagcccttgaggaagcagtctcgtgtcctccgtgtgaaggcagctggatcacttcccgcagtccttgggcagcgctttgctgtggaacacgagagctcctcctcaggggcctggcactcaccttctattctgtatgatgtatttggttaaacactgtcaaataatagagatgtgccagatttagattttcttaccctaatctgtttaatattgtaactttattccatttgaaagtgtcaagcccattcagataagctataatctggtctttaaggaacacaactttaaaactgcagctttcttttatataaatcaagcctctgttaacttgaattccttatagtacatattttcccatctgtaatgacgaaattttgattctaatattttttctattatttataagtgcaaattttttaaaaaagtgtacagctttctaaaagtaataaaggtttagcataaatacagacttccagtagtcaa

SEQ ID NO: 279803 - DNA, 1646 bp, Homo sapiens
tgttcttccaacacttcattgaatgtatttttcactttaataactatgagaagcatgagaagtacaacaagttcccccagtcagagagagagaagcggctgttttcattgaagggaaagtcaaacaaagagagacgaatgaaaatctacaaatttcttctagagcacttcacagatgaacagcgattcaacatcacttccaaaatctgccttagtattttggcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaagagcaggcatcggagtcggagcttaggagtgctgcctttcactttaaattctggaagcccagaaaaaacgtgcagtcaggtgtcttcatacagtttggagcaagagtcgaatggcgagattgagcacgtgaccaagcgggccatcagcacccccgagaagagcatcagtgatgtcacgtttggagcaggggtcagttacatcgggacaccacggactccgtcgtcagccaaaggagcccaaagctgggacgctacatggaagacaccagtgtccctgcagtgcccacctgagagctgtgctggatgaagcaagggccacgtgagtaaagctcactgggacacagccactgccagggcccaaggatggcagggcctcctggcagacagcgaggcaacagtgagctagagcgggggcgcctggcgcaaccccaggagctgactggcatctgtgtatgtacatctgagggcttctgggtggcctctgggtacagactgtcctagtcatctcaggaagaggcagttcaaagctaacctgagaggtttcttttgaagagatgcaaactgatttcaacattgcttaactggaatttttaaaggtttcctaagcaactatggtctgatgtgtagacagtatgagttcccttgtgaaaaaggctaaaacttgtgtgagaaaaggaacatcacagtaaacttccatgagagg

SEQ ID NO: 279804 - DNA, 1679 bp, Homo sapiens
gactgttactgctacaatcaaaattcccaagtggagtggaaatacatatggtcaactatgcagggagactgtgtgcttctctgtggagcctgtcaagaagatatttaactatatgatacatgtgaatcgaaacatcatggatttcaaactcttccttgtgtttgtggcaggagtttttcttttcttttatgcaaggaccctgagtcaaagccctactttctattactcctcgggaactgtgctaggtgttctaatgacattagtctttgtcttgctgttggtgaaaagattcattccgaagtatagcaccttttgggctctaatggttggttgttggtttgcctcagtttatattgtatgccagttgatggaagatctgaagtggctgtggtatgaaaacaggatatatgtattaggctatgtcttgatagttggatttttcagctttgttgtttgttacaagcatgggccccttgcagacgacaggagcagaagtcttctgatgtggatgctgcgactcctctccctggttctggtctatgctggtgtggccgtgcctcagtttgcctatgcagccataatcctcctcatgtcctcctggagtctgcactacccactgagagcatgcagttatatgaggtggaaaatggagcagtggtttacatcaaaagagctggtggtgaaatatcttacggaagacgagtacagggagcaagctgatgctgaaacgaacagtgctctggaggagctacgccgggcctgccgaaaacccgactttccctcatggctggtcgtctccagactccacactcctagcaaatttgcagactttgttcttggaggaagccacttgtcacctgaagaaatcagtctgcatgaagagcagtatggccttgggggtgccttcttggaagagcagctctttaacccgagtactgcctgacatgcgaccttcaagttgacttcattctggacaaggaagtgggcaaagggcagggattctattaaagttaggcagaactgttctagtgaacggtggcaaaaacatttgctgtggagaaaaacaagtcagtctggaaaggaaaaccaacccattttgaagataacttagcattcttggtgacttctgctacttattgtactgtaggtggataccaaaattctgtgacagccactaccacttaccttgaatgaaggctttcattaggaacaggggaatggcgttgttcttaaggggctagtaagcatgaacaggtgctttgtcgacaccagggcactaaatctggtcttaatcccctgaacctgtgtcagaagactctgcaatactcttcctatagttcgtcagtataagtccttaaagagacctgagacatgctggaccagtgttttccaaagtacagctcacaggctactaccaagtgttggtcaataaaggtattctgaggtcaactaagattgatataaagttaaactaatgtatttcagtatctctcagaggcattcataatgctcgtgtgcactgtgaatctcccaaaggggagaaattgtgtgctgcagtttcttgcttaatttgaccacagaactctttttcatgagattaatattccttggaacacgtttggaaaatgctaatggtggtggaactgagctcatgagaggttaaataacttgtgcaagac

SEQ ID NO: 279805 - DNA, 912 bp, Homo sapiens
ggcagttggacattttgtaattttagaattagaagcaaccgcgcgatccagtcgcccaattccctcgttttacagaagcaaccgaaactcagagaggttttgatttgcccagggtcacacagcttgtcactggcacagctgaccctagtctccagactttcagcacacggccttttgtacagtacatcaatgcgtgttgaaatccttgttatttcactatctcgcattcctttggtctcaagactagagaaggtaacagcttcagcttcagaatcggagcgaaaattcttctgcccctgactgttgtgaccttgagcgagtaaacataacggtcccacgtgagcggcaggtgaaaattaccagtccaggcctgttcagaattgtatatatcgcagaaagacataattgccaatatccagaaaacattctatcttttatcaaatgtgtgattcataacttttggataccaaaggaatctaacgaaataaccataatcatcaatccatacagggagactgtgtgcttctctgtggagcctgtcaagaagactctgcaatactcttcctatagttcgtcagtataagtccttaaagagacctgagacatgctggaccagtgttttccaaagtacagctcacaggctactaccaagtgttggtcaataaaggtattctgaggtcaactaagattgatataaagttaaactaatgtatttcagtatctctcagaggcattcataatgctcgtgtgcactgtgaatctcccaaaggggagaaattgtgtgctgcagtttcttgcttaatttgaccacagaactctttttcatgagattaatattccttggaacacgtttggaaaatgctaatggtggtggaactgagctcatgagaggttaaataacttgtgcaagac

SEQ ID NO: 279806 - DNA, 2126 bp, Homo sapiens
ggcagttggacattttgtaattttagaattagaagcaaccgcgcgatccagtcgcccaattccctcgttttacagaagcaaccgaaactcagagaggttttgatttgcccagggtcacacagcttgtcactggcacagctgaccctagtctccagactttcagcacacggccttttgtacagtacatcaatgcgtgttgaaatccttgttatttcactatctcgcattcctttggtctcaagactagagaaggtaacagcttcagcttcagaatcggagcgaaaattcttctgcccctgactgttgtgaccttgagcgagtaaacataacggtcccacgtgagcggcaggtgaaaattaccagtccaggcctgttcagaattgtatatatcgcagaaagacataattgccaatatccagaaaacattctatcttttatcaaatgtgtgattcataacttttggataccaaaggaatctaacgaaataaccataatcatcaatccatacagggagactgtgtgcttctctgtggagcctgtcaagaagatatttaactatatgatacatgtgaatcgaaacatcatggatttcaaactcttccttgtgtttgtggcaggagtttttcttttcttttatgcaaggaccctgagtcaaagccctactttctattactcctcgggaactgtgctaggtgttctaatgacattagtctttgtcttgctgttggtgaaaagattcattccgaagtatagcaccttttgggctctaatggttggttgttggtttgcctcagtttatattgtatgccagttgatggaagatctgaagtggctgtggtatgaaaacaggatatatgtattaggctatgtcttgatagttggatttttcagctttgttgtttgttacaagcatgggccccttgcagacgacaggagcagaagtcttctgatgtggatgctgcgactcctctccctggttctggtctatgctggtgtggccgtgcctcagtttgcctatgcagccataatcctcctcatgtcctcctggagtctgcactacccactgagagcatgcagttatatgaggtggaaaatggagcagtggtttacatcaaaagagctggtggtgaaatatcttacggaagacgagtacagggagcaagctgatgctgaaacgaacagtgctctggaggagctacgccgggcctgccgaaaacccgactttccctcatggctggtcgtctccagactccacactcctagcaaatttgcagactttgttcttggaggaagccacttgtcacctgaagaaatcagtctgcatgaagagcagtatggccttgggggtgccttcttggaagagcagctctttaacccgagtactgcctgacatgcgaccttcaagttgacttcattctggacaaggaagtgggcaaagggcagggattctattaaagttaggcagaactgttctagtgaacggtggcaaaaacatttgctgtggagaaaaacaagtcagtctggaaaggaaaaccaacccattttgaagataacttagcattcttggtgacttctgctacttattgtactgtaggtggataccaaaattctgtgacagccactaccacttaccttgaatgaaggctttcattaggaacaggggaatggcgttgttcttaaggggctagtaagcatgaacaggtgctttgtcgacaccagggcactaaatctggtcttaatcccctgaacctgtgtcagaagactctgcaatactcttcctatagttcgtcagtataagtccttaaagagacctgagacatgctggaccagtgttttccaaagtacagctcacaggctactaccaagtgttggtcaataaaggtattctgaggtcaactaagattgatataaagttaaactaatgtatttcagtatctctcagaggcattcataatgctcgtgtgcactgtgaatctcccaaaggggagaaattgtgtgctgcagtttcttgcttaatttgaccacagaactctttttcatgagattaatattccttggaacacgtttggaaaatgctaatggtggtggaactgagctcatgagaggttaaataacttgtgcaagac

SEQ ID NO: 279807 - DNA, 1567 bp, Homo sapiens
ggcagttggacattttgtaattttagaattagaagcaaccgcgcgatccagtcgcccaattccctcgttttacagaagcaaccgaaactcagagaggttttgatttgcccagggtcacacagcttgtcactggcacagctgaccctagtctccagactttcagcacacggccttttgtacagtacatcaatgcgtgttgaaatccttgttatttcactatctcgcattcctttggtctcaagactagagaaggtaacagcttcagcttcagaatcggagcgaaaattcttctgcccctgactgttgtgaccttgagcgagtaaacataacggtcccacgtgagcggcaggtgaaaattaccagtccaggcctgttcagaattgtatatatcgcagaaagacataattgccaatatccagaaaacattctatcttttatcaaatgtgtgattcataacttttggataccaaaggaatctaacgaaataaccataatcatcaatccatacagggagactgtgtgcttctctgtggagcctgtcaagaagatatttaactatatgatacatgtgaatcgaaacatcatggatttcaaactcttccttgtgtttgtggcaggagtttttcttttcttttatgcaaggaccctgagtcaaagccctactttctattactcctcgggaactgtgctaggtgttctaatgacattagtctttgtcttgctgttggtgaaaagattcattccgaagtatagcaccttttgggctctaatggttggttgttggtttgcctcagtttatattgtatgccagttgatggaagatctgaagtggctgtggtatgaaaacaggatatatgtattaggctatgtcttgatagttggatttttcagctttgttgtttgttacaagcatgggccccttgcagacgacaggagcagaagtcttctgatgtggatgctgcgactcctctccctggttctggtctatgctggtgtggccgtgcctcagtttgcctatgcagccataatcctcctcatgtcctcctggagtctgcactacccactgagagcatgcagttatatgaggtggaaaatggagcagtggtttacatcaaaagagctggtggtgaaatatcttacggaagacgagtacagggagcaagctgatgctgaaacgaacagtgctctggaggagctacgccgggcctgccgaaaacccgactttccctcatggctggtcgtctccagactccacactcctagcaactgatgaaaccaaggccctgaaaggttcaccaagttgccagggtcgtgcagatcaacaaactgcagaagcaagactcaaccaggtcttctgctgtcaaatcctgtgcccttcccatggccagcagagcctcccccagctggatcagaaacctttcagggaaatttagaaggtgctttctttcatacacacaaaaagtagtgatcacttaaccttaaaatcttgtttcacaaagatgttgtaatattatacctatacttaaaacgttagatttctaataaaatttaattaatagagctatga

SEQ ID NO: 279808 - DNA, 1279 bp, Homo sapiens
agactatcctggctagcacggtgaggccccgtctctactaaaaatacaaaaaaaaaaaaaatagctgggcgtggtggtgggcacctgtggtcccagctgcttgggaggttgaggcaggagaatggcgtgaccccaggaggcggcttgcagtgagcccagatcatgccactgcactccagcctgggtaactgagcgagactccgtctcaaaaaaaaaaaaaaaaaaaaaaatgtgtgtgtgtatatatatatatatatatatatatatatatgtatgtgtgtgtgtatacatatgtatgtatatgtgtatatatgtgtgtgtatatatgtatatgtgtatatatatataaatacgtgtgtgtgtgtgtgttttatatatatatatgtatatatgatacaagacaacatggaatgtcttgtagcttaaactccaccctagacttctggggctgttctccagagcaccacgcctaaatgtttgctcatgttgcctttttccagactgttttcttaaatcctcttttattcaggcatcaccttttctcagatattccccaaccttcccattgctctcatagtccagttatataacttaacataaccctattgtgctttgtcataacgttattaacaagttttttgagatagattgtgaactccaccaagactgtgaactccaccggggtaggaagcatattttactcatttttatatacacaagtcccagcacagagcttgactctaaaaaaaaaaaacccagcaaatgttaattgaagctgcaaagtggaaggaattaacagactagatctcttttcactctggtctcctcttaattgcctactacaacttcttgttcaaagggagggactgcagagggcctcccttgtggcaatctgatcccagttccattcctcttccagcgaatgtcatggtaaccaccagcctctcccattgagccacatcttgttctgcagctgtgcttctgactagagaaacctctccctccatctccccactgcccttctagacctattccagttgcaaatttaacttacagtgtgagtatggggcatagataccatgtattaataataatcatacacaaataaatacattagtgtctttattctagagtagttcccgcttgtcagtctcagactgcagtgctactgcagtctgcacatctagctcctgcaagttgcagcaagtcagaattgcttctggcacacctcttataactggaagtcttggtattgagctagattggaggcattccccag

SEQ ID NO: 279809 - DNA, 1102 bp, Homo sapiens
  misc_feature (1097)..(1097): n is a, c, g, or t
agactatcctggctagcacggtgaggccccgtctctactaaaaatacaaaaaaaaaaaaaatagctgggcgtggtggtgggcacctgtggtcccagctgcttgggaggttgaggcaggagaatggcgtgaccccaggaggcggcttgcagtgagcccagatcatgccactgcactccagcctgggtaactgagcgagactccgtctcaaaaaaaaaaaaaaaaaaaaaaatgtgtgtgtgtatatatatatatatatatatatatatatatgtatgtgtgtgtgtatacatatgtatgtatatgtgtatatatgtgtgtgtatatatgtatatgtgtatatatatataaatacgtgtgtgtgtgtgtgttttatatatatatatgtatatatgatacaagacaacatggaatgtcttgtagcttaaactccaccctagacttctggggctgttctccagagcaccacgcctaaatgtttgctcatgttgcctttttccagactgttttcttaaatcctcttttattcaggcatcaccttttctcagatattccccaaccttcccattgctctcatagtccagttatataacttaacataaccctattgtgctttgtcataacgttattaacaagttttttgagatagattgtgaactccaccaagactgtgaactccaccggggtaggaagcatattttactcatttttatatacacaagtcccagcacagagcttgactctaaaaaaaaaaaacccagcaaatgttaattgaagctgcaaagtggaaggaattaacagactagatctcttttcactctggtctcctcttaattgcctactacaacttcttgttcaaagggagggactgcagagggcctcccttgtggcaatctgatcccagttccattcctcttccagcgaatgtcatggtaaccaccagcctccctaagtgctggggttataggagtgagctaccacgcctggcctaatggcttttttttttaagacagagtctcgctctctcgccaggctggaggttgcagtgaacggagattgcgccactgtactccagcctgggtgagagagtgagacgccncctca

SEQ ID NO: 279810 - DNA, 571 bp, Homo sapiens
gtgctttattgctaacctaggcgatgggaagaaagagaacacagctatctttccaagctgtgtgcagcatggagcaccagctgcccttgagacagaagaaagctgttgttttcatcaggagacattcaactccttgaaaatgaacaatccggccaggcgcggtggctcacgcctgtaaatcccagcactttgggaggccgaggcgggcagatcacctgaggtcaggagttcaagaccagcctgaccaacatggagaaaccccctctctactaaaaatgcaaaattagccagcatggtggtgcatgcctgtaatcccagctactcgggaggctgaggcaggagaatcgcttgaacccaggaggtggaggttgcggtgagccgagatcacgccattgcactccagcctgggcaacaagagcgaaactccatctcaaaaaaaaaaaagaaagaaaatgaacaattctcttcaaatccccagctcttagcagagtatatgtacattgtaggcattcagttaggtttgtggaaagaatggcatctgaaacctcaaccgaaaattgaacattccccc

SEQ ID NO: 279811 - DNA, 619 bp, Homo sapiens
ttaaaaaattgcttaaaatacccaagagagacccatattattttgattgggttttgtgtgtgtgttgtgagtttattgtccagttctcttcctgtgcctgttctgtgtgtctattgtaatatataaaacgattttatggtccttattttcatatttctatctctaggagacattcaactccttgaaaatgaacaatccggccaggcgcggtggctcacgcctgtaaatcccagcactttgggaggccgaggcgggcagatcacctgaggtcaggagttcaagaccagcctgaccaacatggagaaaccccctctctactaaaaatgcaaaattagccagcatggtggtgcatgcctgtaatcccagctactcgggaggctgaggcaggagaatcgcttgaacccaggaggtggaggttgcggtgagccgagatcacgccattgcactccagcctgggcaacaagagcgaaactccatctcaaaaaaaaaaaagaaagaaaatgaacaattctcttcaaatccccagctcttagcagagtatatgtacattgtaggcattcagttaggtttgtggaaagaatggcatctgaaacctcaaccgaaaattgaacattccccc

SEQ ID NO: 279812 - DNA, 769 bp, Homo sapiens
gttccattcctcttccagcgaatgtcatggtaaccaccagcctctcccattgagccacatcttgttctgcagctgtgcttctgactagagaaacctctccctccatctccccactgcccttctagacctattccagttgcaaatttaacttacagtgtgagtatggggaaaattttaagagcataagtgctaaatacaacatccaaactacatcaggctcatcatagataccatgtattaataataatcatacacaaataaatacattagtgtctttattctagagtagttcccgcttgtcagtctcagactgcagtgctactgcagtctgcacatctagctcctgcaagttgcagcaagtcagaattgcttctggcacacctcttataactggaagtcttggtattgagctagattggaggcattccccagctatagcatagtgtgtgctttattgctaacctaggcgatgggaagaaagagaacacagctatctttccaagctgtgtgcagcatggagcaccagctgcccttgagacagaagaaagctgttgttttcatcaggtaggctgtgtgtttctctgttaagtaggctgaggggcatctggtctgcaggagctggcatttaatttgaagatgttgaggccttaaaagattgaacttgtgggtctgatagcctaattagaacaagctatgtgtgggggctgccgtactcaaatctgtttttaatggctcagttcagggctgagggggagcaatgtcaaaatta

SEQ ID NO: 279813 - DNA, 1947 bp, Homo sapiens
attaattacgccaagaaaatcactgacgacctctcggcaagcccctccccagcggtgtgatcctggacccaagggcttgggtgatgcccacacaacacttaaggacaggtctgacccgaccccactacaccacacctagagcccggtcttgcacgggcagggtggggagccgagtgacccctcccggcgcccgccccacctcccgagctggctgggctgccacgtcaggcgcagccggccacgatcctgcccatcctcctcccgcccgtcccattgattcgcgggtttcctgcaaccccgggacccccacgggagatcccggccggagaagcgcccccattcaagcccagagaggggccacgcctgtcggaccccccgtcccacgccaacttttcagacacagcagggccccgcgcagccgggtgcgctccgacagctcaagttcacgcggggaccgactgcagagcggggtccggcgctgcgacacccggcccggagcccaccccgagggcccgcaggccgctgccccccgggtccgggcacccgttaggccggccgagggggtgtgtcgggccggcgcaggccccgcgagccgtggggtggccgaggtcggcgggtcctcggcgagacccggcccccacgcccgagcctctccgggccttcccccgccgctcaccggcgcaggagcgcgtcttccagatcttcagcagcaggatgacgatggccgccaggtgggacaggtccccagtcagccggaaaatgttcatggcggcggcggcggtggcggtcggcgcagcgcggcggccccggggctgggcggctcaggaggcggcggcccctgagaggaagcggcgaagatggcgagatcgcccgcgacgtggccagggacgtggccgaactgccggcgcgcgcgcgcgcggggcaccctgggagagcggggccaggccccgccccttaaagggggcgcgccccagcgcaggctcagcaggtcagctcgcagggactcccttgcaagaagaccccggactctgccaaattttccctgccgggtttccggcttctcctcgggtgccagcagtttcctttacttttttgaaataacactccctggggatcttttctttcctcccacatatcaaaagagctctacaggcctattgtatgaaaaagtgtaagagaaggccgggtgcggtggctcatgcctgaaattctagcagtttgagaggccgaaacaggaggatcctttgagcctaggagttcgagaccagcctgggcaacctaatgagagttcctccaccccccgtctctacaaaaattttttaaaaaattagccaggcctgatggtgggtgcctgtagtaccagctattttaaaggctaaggcaggaggattgcttgagcccaggacatcgaggctgcggtgaaccatgattgtaccactgtattccagcctggacgactgagtgagaccctgtctcaaacaaaacaaaacaaaacaaaaaaaagtacaagaggaaaaaaattgatttctgattgcctcactcaagataaggtcaacattgaaggtggaggtggaagatgcagtttatgtaggggtctgaagattttaccattctggggactgtctttaagaaagagaatccaaaattaggtagaaaagtgaacgtctgaccgggcgcggtggctcatccctgtaatcccagcacttaaggagtacgagacgggaggatcacgaggtcaagagatcgacagcatgctggccaacgtggtgaaaccccgtctctactgaaaatacaaaaattagccgggcgtggtggcacgcacctgtaatcccagctactcgggaggctgaggcagggagaatcgcttgaacctgggaggagaaggttgcagtgagctgagatggtgccactgcactccagcctggcgacagagcaagactccatccc

SEQ ID NO: 279814 - DNA, 261 bp, Homo sapiens
cccaaggtggcagaggagtgatgctggagcccggggcaaaatgctggggcccgggacacggctgaaagttccgtcgtgctgcttatttttgggctcctaggtgttgcgcacaaccagcgactgctccagctcctgcctgcgctgctggatctttagaggaagtgagaacaggagcaggtgtcagtgttctgtactccctgagtctccctcttcaccttgaggtcccggctctgggagcggagcaggtcttggacatagcct

SEQ ID NO: 279815 - DNA, 533 bp, Homo sapiens
atttagtaaagacggggtttcaccatgttagccaggatggtggctgacgtgcaccgcaccctggtctatggaggaatcttcctgtacccagccaaccagaagagccctaagggcaagctccggctcctgtatgaatgcaatcccgtggcctacatcattgagcaggcaggaggcttggcgaccacggggacccagcctgtactggacgtgaagcccgaggcaattcaccagcgagtccccctcattctggggtcaccagaggatgtgcaggaatatctcacctgtgtgcagaaaaatcaggcaggcagctagcgagtttgaccccacatgccctcttctgtttgtcttgcaccttgtctaaggaccctaaatgaacgataaacagagatggtagctatgagtatacaaaaggtaaatccacttaatcacatacagaagagcaacaacaaactgcttacgacaggtttggaagccacaggcgattctatggtcaatgtgaaggactagaaataaaaacccacatgtggaaaaag

SEQ ID NO: 279816 - DNA, 686 bp, Homo sapiens
acttgctttatgaatctgggtgcccctgtgttaggtgcatattatttaggatagttaagtcttcttgttgaattgagccctttaccattatgtaatgtccttttcgtcttttttgaactttattggtttaaagtctattttgtctgaaattaggattgcagcccctgcttttttctgctttctatatgtttggcttccatccctttattttgagcctataggtggcactgcatgtgggatgggtgacttcctttttctttgtttgtttagcggctcttttaagattgctgcaggatattgtctcatactttaagcagtcctgcatttgttaagtccagtcacaaggtaaggtttgaggagctcataataaatgaaatgcacaattatataatcttttcaattcctacactagtgggtggaggatagggattcaagaaggcagaggtcacaccaactggacttgtgaccacgagcaggtgctggctaatcctgaaagccactggatcttgtctcttcgctttctgtcttctaggatggcagtgctccctatggggccaggtatgtgggctccatggtggctgacgtgcaccgcaccctggtctatggaggaatcttcctgtacccagccaaccagaagagccctaagggcaaggtaattctcccttgtccactggctgtgcatccgg

SEQ ID NO: 279817 - DNA, 1308 bp, Homo sapiens
gctgcagccctcagaagtaagcaaggtttcctgccgggagaaaaggatttgaagcattccagccaaaatgacggacagaagccccttcgaaaccgacatgctcaccctgacccgctacgttatggaaaaggggcgtcaggccaaagggactggggagctcacccagctgctgaactcaatgctgacggccatcaaagccatctcctcggctgtgcgcaaggccggtctggcccacctgtatggaatcgcaggaagcgttaacgtgacgggagatgaggtgaagaaactggatgtgctatccaattccctggtgatcaacatgctccaatcctcctatagtacctgcgtcctggtctcagaagagaataaggacgccatcatcaccgccaaggagaagcgggggaaatacgtggtctgctttgacccactggatggatcttccaatattgactgcctggcctccatcggaaccatctttgccatctatagaaagacctcagaggatgagccttctgaaaaggatgccctgcagtgtggccgcaatattgtggccgcaggttatgcgctgtacggtagtgcaaccctggtggctctctccacagggcaaggcgtggacctcttcatgcttgacccggctcttggtgaatttgtcctggtggaaaaagatgtcaagattaagaagaaaggaaagatttacagcctgaatgagggctatgccaagtattttgatgcggccaccactgaatatgtgcagaaaaagaaattccctgaggatggcagtgctccctatggggccaggtatgtgggctccatggtggctgacgtgcaccgcaccctggtctatggaggaatcttcctgtacccagccaaccagaagagccctaagggcaagctccggctcctgtatgaatgcaatcccgtggcctacatcattgagcaggcaggaggcttggcgaccacggggacccagcctgtactggacgtgaagcccgaggcaattcaccagcgagtccccctcattctggggtcaccagaggatgtgcaggaatatctcacctgtgtgcagaaaaatcaggcaggcagctagcgagtttgaccccacatgccctcttctgtttgtcttgcaccttgtctaaggaccctaaatgaacgataaacagagatggtagctatgagtatacaaaaggtaaatccacttaatcacatacagaagagcaacaacaaactgcttacgacaggtttggaagccacaggcgattctatggtcaatgtgaaggactagaaataaaaacccacatgtggaaaaag

SEQ ID NO: 279818 - DNA, 677 bp, Homo sapiens
caaagatgaatccgttggtgagtttttgaaggactcttcccttcttgcctcctgggacccatgagctttgtttttctaatgaaggccataattgttcatagttcctagttgtacttgtgagcaaggggctgtgcacctccactgttggtgtggctgaaaggcttgtcttcctgtccttgcaagaacctgcctgggtgcagcaccctaggctcctgtctgtgggctctgtggtgtctgcatggctgaggctgctggggagatggctgctggcactggcagtgggccgttttctctctggttgtttgtatgatctttccctaagtcttgctttttcagtaggatgtgctcatgtggcattgttttgatttgtcttgatgagctcagtgagcctctttaatccatgactcagtgttgggaaactgtcaccattctgtggatagttccctcttcaatcctgcaattgcttgctggatgtgtactggtgtttcccattctctcttccatgtcttttagcctagtcccgccatttaagtcttagttctctcttcaggtgtggcaggtctctgtgaacccacctgctggattactttcaaagagcactttccattttctaggtttctatttgtctgtacatcactacccagcctgtctcataactccgtggagtgtggggtgcc

SEQ ID NO: 279819 - DNA, 638 bp, Homo sapiens
tcctaagaatagaaggtggtggtgtaagtcagactacctccaattgcagcttgaatagttttacaaaaagtaaatttgacactctatgcgtgtttaattgttatgtttcttaatttttaggaatcagtgcactccactgttacttgctgccacttcaggagcactggacactattcaatacctgttttctatcggtgctaactggagaaaaacagatattaaaggaaataatataatccatttatcagtgttaacctttcatacagaggttctcaaatatataataaaattaaatattcctgaactcccagtgtggaaaactttggtaggtgagtataatctctttataaatacatgttctgattattattcagtttagttattgatactctgaaagagagaaaataaaataatacatgcattatattttaaatatttaaaaatcatgaaataaacattttattaagaccagaaataaaaatatgaataataaagagctgcatttttgtgtgtgcaaacgtagttttatttccatgttaaaatcaaagatctgtgacccagactatattttacacaattatatttatttttattttccaactttctccagaagttcaaacatcctctccttcatcaaa

SEQ ID NO: 279820 - DNA, 1390 bp, Homo sapiens
tcctaagaatagaaggtggtggtgtaagtcagactacctccaattgcagcttgaatagttttacaaaaagtaaatttgacactctatgcgtgtttaattgttatgtttcttaatttttaggaatcagtgcactccactgttacttgctgccacttcaggagcactggacactattcaatacctgttttctatcggtgctaactggagaaaaacagatattaaaggaaataatataatccatttatcagtgttaacctttcatacagaggttctcaaatatataataaaattaaatattcctgaactcccagtgtggaaaactttggtaggcatttcaaatagatgttaaggaacaaggagctgttgcactttgggccttggcaggacaaacactaaaacaacaaaaatatatggcagaacaaattggatacagctttataataaatatgcttttgtcaccatcagctaaaatgcagtatgttggatatttgcttaagagcaggctatgcattaacactttttgccttcaataatcgctttcaacaatacttaatattggaaagtggaataatgaccatatctatttttgaacgttttcttgaatcaacagttgaaactgagaaggcaatggcagcatttcagattgttgtactggctaaagtcattagagatatggaccatattactttgtctgcaagaggtgttactattttagttgatagtctgtattcagttcagacttctactattgtcttgacagggaatttaatagcaagcctggctcattctagagctggtatcccagaagcatttaccacattaggaacaatccaacggctctgctatcatttgtactcgggaatagaagaggttcgtgcagcttgttcctctgctcttggctacttaacatacaatgcaaatgctttccgcatcctattaaaagaatgcaggaataaacctaatcagttcattcgtataaaaaataatatcagcagagatgcaagtattaacccagcatttttaaaggaatttcaaatgcaacaaacactggtgggacttccttccttaagtctggagaagaatggaggaccatccataattcctatctttaaaagagggaaggagcaccgaagaaaattaaaacctaaaattcaaccaaaagattctttgactttattacctcctgtaactaacttcatgggactcttcaaagcaacaaaaaagaccaaggattcccataatattttttctttttcatctacaattacatcagatatcacaaatgtatcaagaccaagaatagtgtgtttgaaccaacttgggaaacatgtccagaaagccaacccagagcctgcagaaggctaataaaacattttagaatgaaaagatt

SEQ ID NO: 279821 - DNA, 1190 bp, Homo sapiens
tcctaagaatagaaggtggtggtgtaagtcagactacctccaattgcagcttgaatagttttacaaaaagtaaatttgacactctatgcgtgtttaattgttatgtttcttaatttttaggaatcagtgcactccactgttacttgctgccacttcaggagcactggacactattcaatacctgttttctatcggtgctaactggagaaaaacagatattaaaggaaataatataatccatttatcagtgttaacctttcatacagaggttctcaaatatataataaaattaaatattcctgaactcccagtgtggaaaactttggtaggcatttcaaatagatgttaaggaacaaggagctgttgcactttgggccttggcaggacaaacactaaaacaacaaaaatatatggcagaacaaattggatacagctttataataaatatgcttttgtcaccatcagctaaaatgcagtatgttggatatttgcttaagagcaggctatgcattaacactttttgccttcaataatcgctttcaacaatacttaatattggaaagtggaataatgaccatatctatttttgaacgttttcttgaatcaacagttgaaactgagaaggcaatggcagcatttcagattgttgtactggctaaagtcattagagatatggaccatattactttgtctgcaagaggtgttactattttagttgatagtctgtattcagttcagacttctactattgtcttgacagggaatttaatagcaagcctggctcattctagagctggtatcccagaagcatttaccacattaggaacaatccaacggctctgctatcatttgtactcgggaatagaagagtctggagaagaatggaggaccatccataattcctatctttaaaagagggaaggagcaccgaagaaaattaaaacctaaaattcaaccaaaagattctttgactttattacctcctgtaactaacttcatgggactcttcaaagcaacaaaaaagaccaaggattcccataatattttttctttttcatctacaattacatcagatatcacaaatgtatcaagaccaagaatagtgtgtttgaaccaacttgggaaacatgtccagaaagccaacccagagcctgcagaaggctaataaaacattttagaatgaaaagatt

SEQ ID NO: 279822 - DNA, 1300 bp, Homo sapiens
tcctaagaatagaaggtggtggtgtaagtcagactacctccaattgcagcttgaatagttttacaaaaagtaaatttgacactctatgcgtgtttaattgttatgtttcttaatttttaggaatcagtgcactccactgttacttgctgccacttcaggagcactggacactattcaatacctgttttctatcggtgctaactggagaaaaacagatattaaaggaaataatataatccatttatcagtgttaacctttcatacagaggttctcaaatatataataaaattaaatattcctgaactcccagtgtggaaaactttggtaggcatttcaaatagatgttaaggaacaaggagctgttgcactttgggccttggcaggacaaacactaaaacaacaaaaatatatggcagaacaaattggatacagctttataataaatatgcttttgtcaccatcagctaaaatgcagtatgttggatatttgcttaagagcaggctatgcattaacactttttgccttcaataatcgctttcaacaatacttaatattggaaagtggaataatgaccatatctatttttgaacgttttcttgaatcaacagttgaaactgagaaggcaatggcagcatttcagattgttgtactggctaaagtcattagagatatggaccatattactttgtctgcaagaggtgttactattttagttgatagtctgtattcagttcagacttctactattgtcttgacagggaatttaatagcaagcctggctcattctagagctggtatcccagaagcatttaccacattaggaacaatccaacggctctgctatcatttgtactcgggaatagaagagtctggagaagaatggaggaccatccataattcctatctttaaaagagcatgtcacctggtgctatgtccaaagactttccaagaagcagaaaatctgaaactccttgaactaatgccaacagacagtgacctccagaaatcaaaagaactaaaaaaggaaattctactttattggtcaacctaatagtaagtgcatgagcctccatatgatgaatgggaatgaatggcttttttaactgtcctaccagctgtaagctaaatgataagcccactcccaggcttaaagcaagtcctggttttatggtagttgcaattgctgagaggtcacttggagagactccactggcagaaagagcttcttgtactattcgttgaatattttctctgtgaagctgttgagctgctggaggaacaatcccacctgttctga

SEQ ID NO: 279823 - DNA, 1123 bp, Homo sapiens
tcctaagaatagaaggtggtggtgtaagtcagactacctccaattgcagcttgaatagttttacaaaaagtaaatttgacactctatgcgtgtttaattgttatgtttcttaatttttaggaatcagtgcactccactgttacttgctgccacttcaggagcactggacactattcaatacctgttttctatcggtgctaactggagaaaaacagatattaaaggaaataatataatccatttatcagtgttaacctttcatacagaggttctcaaatatataataaaattaaatattcctgaactcccagtgtggaaaactttggtaggcatttcaaatagatgttaaggaacaaggagctgttgcactttgggccttggcaggacaaacactaaaacaacaaaaatatatggcagaacaaattggatacagctttataataaatatgcttttgtcaccatcagctaaaatgcagtatgttggatatttgcttaagagcaggctatgcattaacactttttgccttcaataatcgctttcaacaatacttaatattggaaagtggaataatgaccatatctatttttgaacgttttcttgaatcaacagttgaaactgagaaggcaatggcagcatttcagattgttgtactggctaaagtcattagagatatggaccatattactttgtctgcaagaggtgttactattttagttgatagtctgtattcagttcagacttctactattgtcttgacagggaatttaatagcaagcctggctcattctagagctggtatcccagaagcatttaccacattaggaacaatccaacggctctgctatcatttgtactcgggaatagaagagtctggagaagaatggaggaccatccataattcctatctttaaaagagagctctgcggatatagaagttacttgcgacaccaccagatgcaacctgaaggaattgagaaaaccaaaataactatcatatatggatatgaaccaagctgctaattaaacctggagaaaaatatcagcattaaacaataataaactatcccattttgagatgggtaatgggcagatgacatatctatgtaataaaaatttggaaag

SEQ ID NO: 279824 - DNA, 1203 bp, Homo sapiens
tcctaagaatagaaggtggtggtgtaagtcagactacctccaattgcagcttgaatagttttacaaaaagtaaatttgacactctatgcgtgtttaattgttatgtttcttaatttttaggaatcagtgcactccactgttacttgctgccacttcaggagcactggacactattcaatacctgttttctatcggtgctaactggagaaaaacagatattaaaggaaataatataatccatttatcagtgttaacctttcatacagaggttctcaaatatataataaaattaaatattcctgaactcccagtgtggaaaactttggtaggcatttcaaatagatgttaaggaacaaggagctgttgcactttgggccttggcaggacaaacactaaaacaacaaaaatatatggcagaacaaattggatacagctttataataaatatgcttttgtcaccatcagctaaaatgcagtatgttggatatttgcttaagagcaggctatgcattaacactttttgccttcaataatcgctttcaacaatacttaatattggaaagtggaataatgaccatatctatttttgaacgttttcttgaatcaacagttgaaactgagaaggcaatggcagcatttcagattgttgtactggctaaagtcattagagatatggaccatattactttgtctgcaagaggtgttactattttagttgatagtctgtattcagttcagacttctactattgtcttgacagggaatttaatagcaagcctggctcattctagagctggtatcccagaagcatttaccacattaggaacaatccaacggctctgctatcatttgtactcgggaatagaagagtctggagaagaatggaggaccatccataattcctatctttaaaagagttttcctaggacttcagctgagaccatgaaacatagaagtggagaaaagaaggaatgcattactgaaggaaaatcaataaatacggaagctgggaatgagctcagtttcttttggcaacaggattagttaaggttgggaccttattgtgaagacccttaaaagccaggatgaagtgtttgaggttttctatagcagttattaaaagtgtttgcaaaaaggaataagacagtagctcctgaaaacttttatatatgacaaatacaaaagaatgattttactttttcc

SEQ ID NO: 279825 - DNA, 494 bp, Homo sapiens
agtagtattcgttctcttattggtgctaacttgacataacaagctagcaaaccatatagtggtccccacaaatttttggcccctgacatctaaatgtctggaagtactgatctgttctcttagtatgttttagttatgtaaagaaaatagaactacatagaagtagaagtaatgagactatacctagggctctcaggagagacatttaattgtggctaatttttagggaaggagcaccgaagaaaattaaaacctaaaattcaaccaaaagattctttgactttattacctcctgtaactaacttcatgggactcttcaaagcaacaaaaaagaccaaggattcccataatattttttctttttcatctacaattacatcagatatcacaaatgtatcaagaccaagaatagtgtgtttgaaccaacttgggaaacatgtccagaaagccaacccagagcctgcagaaggctaataaaacattttagaatgaaa

SEQ ID NO: 279826 - DNA, 427 bp, Homo sapiens
taaacactccaggtggttctaaaatgcagttaagactgagaacaaccactagaaatcaatggcagttgacagctctctgtaaaaatatggcagttaagcttccgtctatacactgccatttgtttgcatacatatttgcttacacttgctccctcccttacagagactttcctatgaaatagctaattagaacattaagatattttaagaacaaagcccactggttaagaaagaattgtttcttcatttaggttcgtgcagcttgttcctctgctcttggctacttaacatacaatgcaaatgctttccgcatcctattaaaagaatgcaggaataaacctaatcagttcattcgtataaaaaataatatcagcagagatgcaagtattaacccagcatttttaaaggaatttcaaatgcaacaaac

SEQ ID NO: 279827 - DNA, 1484 bp, Homo sapiens
  misc_feature (829)..(829): n is a, c, g, or t
tggcacgaggcgagcacctaaagggcaatattttttgatctcctcttctcgtaaaggggatggaggcggagaaaccgaagtctgtgctgggcttggaagcggacgagggcgctgcgaggaggagcggaaggcggagatgcgccgcggctgcacacggtcgcccgcgccccactccccggcgcctgccttccgcggagacgtcgctggtgtctgccacgtgcggcagcccggagcccaggaggggagggcgggccgcctggcgggggtgggcaatgcctcccggcctccagacgctatataaacagacccggacgcgaggcagcggcggagggcgagcgtgacgctggaggaggagtgggagctcccagcctgcgcgggtcctctctttccctgccagggcttttccgggtaatctgggaccgacagggatgccagcaccccgtcatctcacccaaagggcgccaggccagagattcctggggaaaagtcgccggctgcaggcggttgtcccaggaattcctccatggtgccggcgggagcgcggcgagccggggcgcggcggctgcgggaggtggaggcgacccgggacagggccggtcccagggagaggggatcccccgagccgcgcgttccgccgttcaggccaggtagggggtggggaaggaggaggaagaggatcccgaagcaagacagagctgaggctcagagttctcaggcagcagcttctggaggacaccgtggagacccaaggcggctttatttgggtctgcaaacacccggggccccggttaagattcggcagggccaccccgctcctcccccgccttgnacgaccgcactccgcgcgccttgtcactgcgagggctacctgtcctcgcacactcctccgcgatggccagaaaacgtgggactcgagataagactctggcagatggtactcctccctccgcctaacgtatcaatgcaccaacgcccctgactgcacactcaggaacctgtggcagcctcgccaagggacagcgtgcccagcaccgtgcactgggcactcttggatctggagctcacaactccggaaggaatggggacttagatgaggtgacagacatgcatgcatgcaatgcaggctgaatccgcctgtctggagccaaaaataaacgccatggtcacctctttgttacaacctggatatgatgcccacatgcgtggggtagacatgcttgggatagataagcctgtggacttcagacggtattttctctttcccttttttcttctttctcgtcctcatctctgtccctccctccttttcttctcgccctatctcttcctccctttctactctctctagtgtctcacttgagaaagacctagatttgagtgggaagagttatgccttaaactgttctcattataaattcaaaatgtacttgaagaatacagatcgactgtatgatggcatgaataaagcgctatgctgtaaaaaa

SEQ ID NO: 279828 - DNA, 4794 bp, Homo sapiens
tcctttggatatatgaccagcagtgggattgctggatcttacgatggaattcccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagctta

SEQ ID NO: 279829 - DNA, 5378 bp, Homo sapiens
tcctttggatatatgaccagcagtgggattgctggatcttacgatggaattcccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagcttaagtgaaagtgtttcttggctggaaatgtattacataaatcatttgtatgagcatgagagatgacttgctcatgggatgagcaatgctgtgggtattggatggaccactcaggcagcctggccgcacacacacacatgcatgctacatatgtgtacgctcagaccacatgcctgcacatatgtccacacaccagcccacggctcccttcctcaccccagccctccccactcccaggttaaccaatgtctcgatttgcttcaggcggcatttgtaaactgtcaccctgcttgcaaaccctcatttaaattggtccagcatttgctaccagagtttaggccacaaactttgtaaagctcagtttgtctccttgcagaaagaggttgctgcagtttggagctggttatgccaaggaaaatacggctaaaaaagaacttactgattcccataggtgtgtcaactgacaaatgaatgttccatctccctacgacaatttgctgcccctccccaaaaaaagcactatggccaaaatttcagtttttaaaggttaagtagggtgggataccgggggggatctctagatcacc

SEQ ID NO: 279830 - DNA, 4740 bp, Homo sapiens
tcctttggatatatgaccagcagtgggattgctggatcttacgatggaattcccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttatctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagctta

SEQ ID NO: 279831 - DNA, 4582 bp, Homo sapiens
ggtggttatcagtcacgaggctcagctagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagctta

SEQ ID NO: 279832 - DNA, 4551 bp, Homo sapiens
ggcttattcgacggtgttctgtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagctta

SEQ ID NO: 279833 - DNA, 4533 bp, Homo sapiens
aactctcaactattatgttaataacacagaattaacagggtgaggttatagttcacaaaatggcaagcagacgataaacaggttttcagataaggtatgtaagattctttttctgcagtgttgaagtcaaagcagatgtctgatctcaaaaaggtcagcagtcctagattgaggaattagtgaaatatgtctaaggaagcctccagaaccgtccgggggaaccctcctgctgcgctctcaccagcgtcctttcccgcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagctta

SEQ ID NO: 279834 - DNA, 4121 bp, Homo sapiens
ataagctgatacaattcagctcggtacccacatcaggctcggggttgtcactaggttgagatcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagctta

SEQ ID NO: 279835 - DNA, 4476 bp, Homo sapiens
tcctttggatatatgaccagcagtgggattgctggatcttacgatggaattcccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgctttcgtctgggaaaatgcgtctgataggcaattaagccatgggagtggacatttacacggaggctacgcacatctcaggggaacgctcaaactg

SEQ ID NO: 279836 - DNA, 3856 bp, Homo sapiens
accggtgtgggtgagctgtggggtcctcacattttctcgctttggcgggttacctccccgtcccggcccttctcttccccgcccacggggcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagctta

SEQ ID NO: 279837 - DNA, 1543 bp, Homo sapiens
  misc_feature (1484)..(1484): n is a, c, g, or t
tcctttggatatatgaccagcagtgggattgctggatcttacgatggaattcccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgacctcaggtgatctggctgcctgagtctcccaaagtgctggcattacaggtgtgagccactgcactcggcagaaggttacttttgtagatggngtctcactatgttgccaggctggtctcagactccagggcccgagaagggtccgagagta

SEQ ID NO: 279838 - DNA, 1308 bp, Homo sapiens
tcctttggatatatgaccagcagtgggattgctggatcttacgatggaattcccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagca

SEQ ID NO: 279839 - DNA, 1311 bp, Homo sapiens
ctctacgacggatccccgcgagaatccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagcttaagtgaaagtgtttcttggctggaaatgtattacataaatcatttgtatgagcatgagagatgacttgctcatgggatgagcaatgctgtgggtattggatggaccactcaggcagcctggccgcacacacacacatgcatgctacatatgtgtacgctcagaccacatgcctgcacatatgtccacacaccagcccacggctcccttcctcaccccagccctccccactcccaggttaaccaatgtctcgatttgcttcaggcggcatttgtaaactgtcaccctgcttgcaaaccctcatttaaattggtccagcatttgctaccagagtttaggccacaaactttgtaaagctcagtttgtctccttgcagaaagaggttgctgcagtttggagctggttatgccaaggaaaatacggctaaaaaagaacttactgattcccataggtgtgtcaactgacaaatgaatgttccatctccctacgacaatttgctgcccctccccaaaaaaagcactatggccaaaatttcagtttttaaaggttaagtaaaatacaacaattcttgaaactcttaagagaaccagaattggaaggaaaggagaatggccaaaattatattctcacaacctaaagcagtaaactttaaaaataggttcagtcttagacttgacttaattgacttaggctgggcatagtggctcacacctgtaattccagcaccgtaggaggccaaggcaggctgatcatctgaagtcgggagttcgagaccagcctggctaacatggtgaaatcccgtctctactaaaaaatataaaaattagccgggtgtggtggcaggggcctgtagtcccagctactcaggaggctgaagcaggcgaatcgctggaacacaagaggcagaggttgcagtgagccgagatcacgccactgtactccagcctgtgctacagagcaagactccatctcaattta

SEQ ID NO: 279840 - DNA, 533 bp, Homo sapiens
tcctttggatatatgaccagcagtgggattgctggatcttacgatggaattcccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagca

SEQ ID NO: 279841 - DNA, 445 bp, Homo sapiens
caggttttcagataaggtatgtaagattctttttctgcagtgttgaagtcaaagcagatgtctgatctcaaaaaggtcagcagtcctagattgaggaattagtgaaatatgtctaaggaagcctccagaaccgtccgggggaaccctcctgctgcgctctcaccagcgtcctttcccgcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgaggtaacagttgatccctaagtagaaaccataacaagtcctctcttatttctaaaggtaactccaagattctttgcttagttttgttttgtttttaacaattttggagattttaaccagaaaaaaatc

SEQ ID NO: 279842 - DNA, 5769 bp, Homo sapiens
tcctttggatatatgaccagcagtgggattgctggatcttacgatggaattcccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagcttaagtgaaagtgtttcttggctggaaatgtattacataaatcatttgtatgagcatgagagatgacttgctcatgggatgagcaatgctgtgggtattggatggaccactcaggcagcctggccgcacacacacacatgcatgctacatatgtgtacgctcagaccacatgcctgcacatatgtccacacaccagcccacggctcccttcctcaccccagccctccccactcccaggttaaccaatgtctcgatttgcttcaggcggcatttgtaaactgtcaccctgcttgcaaaccctcatttaaattggtccagcatttgctaccagagtttaggccacaaactttgtaaagctcagtttgtctccttgcagaaagaggttgctgcagtttggagctggttatgccaaggaaaatacggctaaaaaagaacttactgattcccataggtgtgtcaactgacaaatgaatgttccatctccctacgacaatttgctgcccctccccaaaaaaagcactatggccaaaatttcagtttttaaaggttaagtaaaatacaacaattcttgaaactcttaagagaaccagaattggaaggaaaggagaatggccaaaattatattctcacaacctaaagcagtaaactttaaaaataggttcagtcttagacttgacttaattgacttaggctgggcatagtggctcacacctgtaattccagcaccgtaggaggccaaggcaggctgatcatctgaagtcgggagttcgagaccagcctggctaacatggtgaaatcccgtctctactaaaaaatataaaaattagccgggtgtggtggcaggggcctgtagtcccagctactcaggaggctgaagcaggcgaatcgctggaacacaagaggcagaggttgcagtgagccgagatcacgccactgtactccagcctgtgctacagagcaagactccatctcaattta

SEQ ID NO: 279843 - DNA, 5112 bp, Homo sapiens
atgctccgagcgcggcgcccccgacgcggcgctcggctcggctcgggcatttccgcctctttgttttaaactccggacgggcttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagctta

SEQ ID NO: 279844 - DNA, 4978 bp, Homo sapiens
gttcatgtcttgaggacattttattttcctaatggaccacaccaactcttaggaaatgtttaggctcctccgggcgtctgtgacagttggagggtgggaggggcctggctctgtcacccccacggctttgcgggtcccaggaagcacagccatgaggcgtggttaggaagcgagtctgggaaccaagcagtcctgtcagaacccttttacctgaggggaagttttcattttaaaagcggtgttgaaacagtggatttttaggagaaggctttcagatcgaggggctgatgtggtcagcactgagcagctccgggcgggcctggccatgtggccagtgcggagcgtgtctgtgtcccacgccggctccggctgccccgtctctgtctcctgtgctccccacgcctgcaccccacaggcccacacgcccgttctgcatcctggggagacccctgcagacactttgcggacggctttcctttgacgcttactccgctccgggggtccagagtctcttaatggagtgaatttttgacggcatttggagtacagtgtagttttttaaatggcttgacagtttggatttcatggtgcgctatgttctgtttgtgctaaaaggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagctta

SEQ ID NO: 279845 - DNA, 4590 bp, Homo sapiens
tagtgaggacggtgctgatcggacgagggatcacccgagcacctccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagctta

SEQ ID NO: 279846 - DNA, 4740 bp, Homo sapiens
tcctttggatatatgaccagcagtgggattgctggatcttacgatggaattcccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatggcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagctta

SEQ ID NO: 279847 - DNA, 3842 bp, Homo sapiens
tcctttggatatatgaccagcagtgggattgctggatcttacgatggaattcccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgccttattccactctgtgtttttaccttaatcttgcttttttccttcttgt

SEQ ID NO: 279848 - DNA, 1800 bp, Homo sapiens
  misc_feature (1786)..(1786): n is a, c, g, or t
tcctttggatatatgaccagcagtgggattgctggatcttacgatggaattcccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccacgtggcgtcatccnggccgagtcgatca

SEQ ID NO: 279849 - DNA, 1003 bp, Homo sapiens
tcctttggatatatgaccagcagtgggattgctggatcttacgatggaattcccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaattctctctcataaaaaagttggcggccg

SEQ ID NO: 279850 - DNA, 886 bp, Homo sapiens
tgcaatttgatctcagactgctgtgctagcaatcagtgagactccgtgggcgtaggaccctctgagccaggtgcgggatataatcttgtggtgcgccgttttttaagccggtccgaaaagcgcaatattcgggtgggagtgacccgatttcccagctcagaacctgaggacgcagccatggagcggtcggccttcatggagctggatgctgggagcaggctggtgatgcatctccgcgagtggccagccctgctggtcagcagcacgggctggacagagtttgaacaacttactcttgatggacacaaccttccttctcttgtctgtgtgataacagggtcggtggacctgggtgtctgtctgcacatgtcctccagtggcctggacctgcccatgaaggtggtggacatgttcgggtgctgtttgcctgtgtgtgccgtgaacttcaagtgtttacatgagctggtgaaacatgaagaaaatggcctggtctttgaggactcagaggaactggcagctctgcagatgcttttctcaaactttcctgatcctgcaggcaagctaaaccagttttggaagaacctgcgggagtcgcagcagctccgatgggatgagagctgggtgcagactgtgctccctttggttatggacatacaactcctgggccagaggctaaaaccccgggacccctgctgtccttcccgcagcttcttctcggagtctcagggcaaacccttttgagcagcgcctcccagtggccagaagctgaaatgacggcagtggtgccgcctggtgaatgaattggttctgtgacccgggaagctgtgcttggctctgatttcttttccggaggctcggaaacacttcctctcttcttctgttcttc

SEQ ID NO: 279851 - DNA, 997 bp, Homo sapiens
tgcaatttgatctcagactgctgtgctagcaatcagtgagactccgtgggcgtaggaccctctgagccaggtgcgggatataatcttgtggtgcgccgttttttaagccggtccgaaaagcgcaatattcgggtgggagtgacccgatttcccagggctgtgaccatctatgacaagccggcatctttctttaaagagacacctctggacctgctgcaccggctcttcatgaagctgggtggcactcactctccgttcagggcctgctcagaacctgaggacgcagccatggagcggtcggccttcatggagctggatgctgggagcaggctggtgatgcatctccgcgagtggccagccctgctggtcagcagcacgggctggacagagtttgaacaacttactcttgatggacacaaccttccttctcttgtctgtgtgataacagggtcggtggacctgggtgtctgtctgcacatgtcctccagtggcctggacctgcccatgaaggtggtggacatgttcgggtgctgtttgcctgtgtgtgccgtgaacttcaagtgtttacatgagctggtgaaacatgaagaaaatggcctggtctttgaggactcagaggaactggcagctctgcagatgcttttctcaaactttcctgatcctgcaggcaagctaaaccagttttggaagaacctgcgggagtcgcagcagctccgatgggatgagagctgggtgcagactgtgctccctttggttatggacatacaactcctgggccagaggctaaaaccccgggacccctgctgtccttcccgcagcttcttctcggagtctcagggcaaacccttttgagcagcgcctcccagtggccagaagctgaaatgacggcagtggtgccgcctggtgaatgaattggttctgtgacccgggaagctgtgcttggctctgatttcttttccggaggctcggaaacacttcctctcttcttctgttcttc

SEQ ID NO: 279852 - DNA, 645 bp, Homo sapiens
ttctttttcctcttctcttctcttttctcttattttctttttttgaggaggagtttcactcttgtcgcccagactagagcgcaatggtacgatcttggctcactgcaacttccacctcccgagttcaagcaattctcctgacagaagtccactcaagccagccattgtagctagcatcggggctccagccgtcagctgggattacaggcgtgcaccacccagccatctaattttgtgtttttagtagagacagagtttcaccatgttgaccaagttggttttgacctcctgacctcaggtgatccgcccacctcggcttcccaaagtgctgggattacaggcgtgagtcacacaccaggccctttgttaacttttaaccatattgccattttaagcaggtgcacagcactgaacatttgccagtgatgttattaaccactggtaactttaccagcagaatagatagctgaggttgtggatttcttgtattccgtactttctggaatgtcactgtgacttctttcttaggtaccaggaggactttaacccgctggtgatgaggatgtctcctcgttacagctgtaagaatcacactcgggcatacatccaccatctgtgtgacccaagtgagcagaggaccgtctt

SEQ ID NO: 279853 - DNA, 1311 bp, Homo sapiens
gcaggtccacacccaccctgcactctcatgggtctgaaaaggccaagttaggggttgggtgcagaggcttagaaaagtctaggtctcagcattggatatccgggacccccttatactcggccaggctcagggatgaagctccttagagctggccccaaaccaggagctcctggggctgagacagatgcagacctgctctcctgcccctcctaccatcccctggcccccatcatccaacagaagtccaggccagcctgcctcccgctccagtggggcctccattgcgacctgatagacctgtatgggtggctggccccataatcagcatctaccacatcccacgcgcatggggtctctcacagcggcccctgcccatggacagatggactgacccacaggcatccacatgtggtgctgaagaagccgtgaggaaagggggaggtgggaagggcctcgtccagggtgtctggctgcacaggagacatagcagctcccactggcaccctgcatacaagggaaaggcctcgaaatgcgctcaccaaagcctcagagttttattatcaggagctcacattcaggagcaggtctgcttgtcaagagtccaagcacgcctgtgttctgtggccacaggagaggaggggccgcttttaaatacaagcctactcctgtcgttggaccagaacaaagacctactggccagaagcacatgagaggaggagtttcactcttgtcgcccagactagagcgcaatggtacgatcttggctcactgcaacttccacctcccgagttcaagcaattctcctgacagaagtccactcaagccagccattgtagctagcatcggggctccagccgtcagctgggattacaggcgtgcaccacccagccatctaattttgtgtttttagtagagacagagtttcaccatgttgaccaagttggttttgacctcctgacctcaggtgatccgcccacctcggcttcccaaagtgctgggattacaggcgtgagtcacacaccaggccctttgttaacttttaaccatattgccattttaagcaggtgcacagcactgaacatttgccagtgatgttattaaccactggtaactttaccagcagaatagatagctgaggttgtggatttcttgtattccgtactttctggaatgtcactgtgacttctttcttaggtaccaggaggactttaacccgctggtgatgaggatgtctcctcgttacagctgtaagaatcacactcgggcatacatccaccatctgtgtgacccaagtgagcagaggaccgtctt

SEQ ID NO: 279854 - DNA, 595 bp, Homo sapiens
tgacagaagtccactcaagccagccattgtagctagcatcggggctccagccgtcagctgggattacaggcgtgcaccacccagccatctaattttgtgtttttagtagagacagagtttcaccatgttgaccaagttggttttgacctcctgacctcaggtgatccgcccacctcggcttcccaaagtgctgggattacaggcgtgagtcacacaccaggcgtgtttcctccacgtttctgctcaaggcggaaaatctccatctacccttaacttatgactcaatcgtggagctttggccccagatggcacatacaagctccctgcctgccccaagaggtgccctgtgggcatttgcctctgtgacagaagtccactcaagccagccattgtagctagcatcggggctccagccatcagtgagggcagccagggccggtcctcggcctgccccagatggcacattgatgggggctgtgtggacttacagctgggaggggctgctgggcatgcccaggtggggctcttccagtgaggcagcgatgctgaggctgaaggacgaggccgcctatcagaggcccagaggagaaggagg

SEQ ID NO: 279855 - DNA, 527 bp, Homo sapiens
cgtccaccccatccccccccccccccctctcttcttttcccctgtcactctgcctacccatctaaagtcccccagtggcattaagaggacattttgctttgcaagggtctctcttcaaaaggttcaaatgtaagtccctccgatgcctcctttctgctccccgcgcagtgcatagtgaggccactgctgcttacccttcccggaaccacaagattgtcaatgccaatcaaatctttcttgagttcgtgcagcttctggaaattctccatcttgatcatcgtaccgtggagctgtgccaccatctccgtgatctctgccaaagcggctgtgaaggaaagacatacacagtctgcagcgggaaaggcaggcaggggtcttcccctagcagctgtcagctcaacgctgcagggaaatcactccagtccctgcacagtattcaaaggtgtcttttgagcaaaaacagtgctatttctctataataaaaattgatggtgtaaaaaaaaaaaatccggactacctggcctcac

SEQ ID NO: 279856 - DNA, 356 bp, Homo sapiens
ccagttgtctcccaggtggatggaaagaggacattttgctttgcaagggtctctcttcaaaaggttcaaatttcgtgcagcttctggaaattctccatcttgatcatcgtaccgtggagctgtgccaccatctccgtgatctctgccaaagcggctgtgaaggaaagacatacacagtctgcagcgggaaaggcaggcaggggtcttcccctagcagctgtcagctcaacgctgcagggaaatcactccagtccctgcacagtattcaaaggtgtcttttgagcaaaaacagtgctatttctctataataaaaattgatggtgtaaaaaaaaaaaatccggactacctggcctcac

SEQ ID NO: 279857 - DNA, 348 bp, Homo sapiens
ctttttcctcgtggcagtctaaagaagagggaggagcagtctgacaatccggaggagcaagactggcccaaaacactttccttgattggtggagacattctggaggaggagccaagctctgggctaaagtttacaggactcccagcggttcctcttacaggtggcagagtgtgggcaactgaaacccagccagcagaagagagagagatttgggggaaggccaatgccagtgtcatgacactgctcttcacaaacaactgaggacttctagaaatctctgctgtgcagtgtccaccaaagaaattctgaaaattaaatgctgtattgaatacacaggtaaaagcaaac

SEQ ID NO: 279858 - DNA, 2799 bp, Homo sapiens
agcccggagagtgcgcgtggcggcggtggcggctgcggcaacagcggggccgatgtgtagttggtgactgcctctccagatgctgaggtgcctgtatcattggcacaggccagtgctgaaccgtaggtggagtaggctgtgccttctgaagcagtatctattcacaatgaagttgcagtctcccgaattccagtcacttttcacagaaggactgaagagtctgacagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccaggcttcatgaagaaaattttgagattactacactacggattgatgtcaccactgatggaagacatgctgaggtagaatttacaactgactggcagaaagatgcggaacgcagagatctcactataaattctatgtttttaggttttgatggcactttatttgactactttaatggttatgaagatttaaaaaataagaaagttagatttgttggacatgctaaacagagaatacaagaggattatcttagaattttaagatacttcaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtaaccatgtaaatcatttgattcaccttatctatgatcttgatgtggctccttatataggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcgaaagaggagaaaaaccttggcttatttatagttaaaaataggaaagatttaattaaagcaacagatagttcagacccattgaaaccctatcaagacttcattatagattctagggaacctgatgcaactactcgtgtatgtgaactactgaagtaccaaggagagcactgtctcctaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcatttctggtaagactaaattttctcccctccctcttaatgaggttttagagactacaccagaataaaagacagtttaggggacctctgtagaacaacaagggtcttattttgtgaattatatatttcaagaactaaacagagatccacctttctggatctgatttatatcactgaaatgtacagttcttttggaatagtttcacctgagaaaacatagttggctattatctatcttaacctgttcaggcttttaaaaaaaactgtttttgcatagggtagtactaagatcttaaaaagtggtaactgtcttgaagaaaaaacgtttattgtttgtttgcaattgaaataacagggttaccttaacaatgactgtctatgatgtgtcagttcttatctgaattccaaaataaacctgtgcttaaaaaagaaataattgaccaagtaagtttgcataaaatgtgaatactaaatgtgtccccagttgctggcattcatatgtacaggatttgttctagcaagctatgcttcagtatgtggttgatatttttctgtcacaatgatttctttatgcatgcagagcctgggaaagtcatgggattaacttgagggtcactattgagcctattaattaattaattattgttttaataaaacaaacattggtattggaagataaatatgtttatgtggtatctgacaatgtgtattaggtgtcatatacaatggtaatatgcctgtctttaaagtgttattttattaattaaaaggatatggctattattatatattctctaaagatttattctctaaagatttgagtcctaaatgctttcatcaggtaaataaaatgtataatacaaactgtttatttcagctgctataatttcagctgctatactgacatttcataatttatttcctttctgtgtagccagtcataacatctttgtactctatgagcaaatagtaattttggaccttgataaaacaattttgtagagtgtaatatttctaagaggaaatgtcacaggggctatgatgcaagaaagcctcagaaatgactgcatacaggaaataatctcatcatttccaaagatgtcttcatgtcccatcaatgacatgctaccagacatatcagattccacaggataatggcaccaagctacccaagtagatgtttctggtattctagactgccgttcatgcttgtttcctaaagtatacttaaaagtttcaaatacagtttcacttagaaactgcaaccctccaagtaatgttatgtttacttaggtattaatgttatgtttacttaggtatgtatcagaggcaataatttccaaagcagatcttagaatataaccaatttgttagataactaactttatctc

SEQ ID NO: 279859 - DNA, 2333 bp, Homo sapiens
  misc_feature (2292)..(2292): n is a, c, g, or t
  misc_feature (2296)..(2296): n is a, c, g, or t
agcccggagagtgcgcgtggcggcggtggcggctgcggcaacagcggggccgatgtgtagttggtgactgcctctccagatgctgaggtgcctgtatcattggcacaggccagtgctgaaccgtaggtggagtaggctgtgccttctgaagcagtatctattcacaatgaagttgcagtctcccgaattccagtcacttttcacagaaggactgaagagtctgacagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccaggcttcatgaagaaaattttgagattactacactacggattgatgtcaccactgatggaagacatgctgaggtagaatttacaactgactggcagaaagatgcggaacgcagagatctcactataaattctatgtttttaggttttgatggcactttatttgactactttaatggttatgaagatttaaaaaataagaaagttagatttgttggacatgctaaacagagaatacaagaggattatcttagaattttaagatacttcaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtaaccatgtaaatcatttgattcaccttatctatgatcttgatgtggctccttatataggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcgaaagaggagaaaaaccttggcttatttatagttaaaaataggaaagatttaattaaagcaacagatagttcagacccattgaaaccctatcaagacttcattatagattctagggaacctgatgcaactactcgtgtatgtgaactactgaagtaccaaggagagcactgtctcctaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcatttctggtaagactaaattttctcccctccctcttaatgaggttttagagactacaccagaataaaagacagtttaggggacctctgtagaacaacaagggtcttattttgtgaattatatatttcaagaactaaacagagatccacctttctggatctgatttatatcactgaaatgtacagttcttttggaatagtttcacctgagaaaacatagttggctattatctatcttaacctgttcaggcttttaaaaaaaactgtttttgcatagggtagtactaagatcttaaaaagtggtaactgtcttgaagaaaaaacgtttattgtttgtttgcaattgaaataacagggttaccttaacaatgactgtctatgatgtgtcagttcttatctgaattccaaaataaacctgtgcttaaaaaagaaataattgaccaagtaagtttgcataaaatgtgaatactaaatgtgtccccagttgctggcattcatatgtacaggatttgttctagcaagctatgcttcagtatgtggttgatatttttctgtcacaatgatttctttatgcatgcagagcctgggaaagtcatgggattaacttgagggtcactattgagcctattaattaattaattattgttttaataaaacaaacattggtattggaagataaatatgtttatgtggtatctgacaatgtgtattaggtgtcatatacaatggtaatatgcctgtctttaaagtgttattttattaattaaaaggatatggctattattatatattctctaaagattttatttacctgatgaaagcatttctcactgtcaacccaacacaggcatgctcataaggaaaggttggttgattgtagatantggnctgttaattgtcagttcagtgttttcccacgcgtccg

SEQ ID NO: 279860 - DNA, 3001 bp, Homo sapiens
agcccggagagtgcgcgtggcggcggtggcggctgcggcaacagcggggccgatgtgtagttggtgactgcctctccagatgctgaggtgcctgtatcattggcacaggccagtgctgaaccgtaggtggagtaggctgtgccttctgaagcagtatctattcacaatgaagttgcagtctcccgaattccagtcacttttcacagaaggactgaagagtctgacagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccaggcttcatgaagaaaattttgagattactacactacggattgatgtcaccactgatggaagacatgctgaggtagaatttacaactgactggcagaaagatgcggaacgcagagatctcactataaattctatgtttttaggttttgatggcactttatttgactactttaatggttatgaagatttaaaaaataagaaagttagatttgttggacatgctaaacagagaatacaagaggattatcttagaattttaagatacttcaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtaaccatgtaaatcatttgattcaccttatctatgatcttgatgtggctccttatataggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcgaaagaggagaaaaaccttggcttatttatagttaaaaataggaaagatttaattaaagcaacagatagttcagacccattgaaaccctatcaagacttcattatagatgtaagtatatgctaggcttggtcagaaatatgaagtatcgtcacgaatttagaattaatttattaaaactaagatctacaaatctgtgaattttacttattttaaatgaaaaaatttatgttgagtatttaaattttaggataagattgtaagtgtatgttttcatgtgtgacgaaactaaatgtttgattttgacacgtagtctagggaacctgatgcaactactcgtgtatgtgaactactgaagtaccaaggagagcactgtctcctaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcatttctggtaagactaaattttctcccctccctcttaatgaggttttagagactacaccagaataaaagacagtttaggggacctctgtagaacaacaagggtcttattttgtgaattatatatttcaagaactaaacagagatccacctttctggatctgatttatatcactgaaatgtacagttcttttggaatagtttcacctgagaaaacatagttggctattatctatcttaacctgttcaggcttttaaaaaaaactgtttttgcatagggtagtactaagatcttaaaaagtggtaactgtcttgaagaaaaaacgtttattgtttgtttgcaattgaaataacagggttaccttaacaatgactgtctatgatgtgtcagttcttatctgaattccaaaataaacctgtgcttaaaaaagaaataattgaccaagtaagtttgcataaaatgtgaatactaaatgtgtccccagttgctggcattcatatgtacaggatttgttctagcaagctatgcttcagtatgtggttgatatttttctgtcacaatgatttctttatgcatgcagagcctgggaaagtcatgggattaacttgagggtcactattgagcctattaattaattaattattgttttaataaaacaaacattggtattggaagataaatatgtttatgtggtatctgacaatgtgtattaggtgtcatatacaatggtaatatgcctgtctttaaagtgttattttattaattaaaaggatatggctattattatatattctctaaagatttattctctaaagatttgagtcctaaatgctttcatcaggtaaataaaatgtataatacaaactgtttatttcagctgctataatttcagctgctatactgacatttcataatttatttcctttctgtgtagccagtcataacatctttgtactctatgagcaaatagtaattttggaccttgataaaacaattttgtagagtgtaatatttctaagaggaaatgtcacaggggctatgatgcaagaaagcctcagaaatgactgcatacaggaaataatctcatcatttccaaagatgtcttcatgtcccatcaatgacatgctaccagacatatcagattccacaggataatggcaccaagctacccaagtagatgtttctggtattctagactgccgttcatgcttgtttcctaaagtatacttaaaagtttcaaatacagtttcacttagaaactgcaaccctccaagtaatgttatgtttacttaggtattaatgttatgtttacttaggtatgtatcagaggcaataatttccaaagcagatcttagaatataaccaatttgttagataactaactttatctc

SEQ ID NO: 279861 - DNA, 2787 bp, Homo sapiens
cgactcagaattacagagctttccagagcttatataccttatgtgtagttggtgactgcctctccagatgctgaggtgcctgtatcattggcacaggccagtgctgaaccgtaggtggagtaggctgtgccttctgaagcagtatctattcacaatgaagttgcagtctcccgaattccagtcacttttcacagaaggactgaagagtctgacagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccaggcttcatgaagaaaattttgagattactacactacggattgatgtcaccactgatggaagacatgctgaggtagaatttacaactgactggcagaaagatgcggaacgcagagatctcactataaattctatgtttttaggttttgatggcactttatttgactactttaatggttatgaagatttaaaaaataagaaagttagatttgttggacatgctaaacagagaatacaagaggattatcttagaattttaagatacttcaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtaaccatgtaaatcatttgattcaccttatctatgatcttgatgtggctccttatataggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcgaaagaggagaaaaaccttggcttatttatagttaaaaataggaaagatttaattaaagcaacagatagttcagacccattgaaaccctatcaagacttcattatagattctagggaacctgatgcaactactcgtgtatgtgaactactgaagtaccaaggagagcactgtctcctaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcatttctggtaagactaaattttctcccctccctcttaatgaggttttagagactacaccagaataaaagacagtttaggggacctctgtagaacaacaagggtcttattttgtgaattatatatttcaagaactaaacagagatccacctttctggatctgatttatatcactgaaatgtacagttcttttggaatagtttcacctgagaaaacatagttggctattatctatcttaacctgttcaggcttttaaaaaaaactgtttttgcatagggtagtactaagatcttaaaaagtggtaactgtcttgaagaaaaaacgtttattgtttgtttgcaattgaaataacagggttaccttaacaatgactgtctatgatgtgtcagttcttatctgaattccaaaataaacctgtgcttaaaaaagaaataattgaccaagtaagtttgcataaaatgtgaatactaaatgtgtccccagttgctggcattcatatgtacaggatttgttctagcaagctatgcttcagtatgtggttgatatttttctgtcacaatgatttctttatgcatgcagagcctgggaaagtcatgggattaacttgagggtcactattgagcctattaattaattaattattgttttaataaaacaaacattggtattggaagataaatatgtttatgtggtatctgacaatgtgtattaggtgtcatatacaatggtaatatgcctgtctttaaagtgttattttattaattaaaaggatatggctattattatatattctctaaagatttattctctaaagatttgagtcctaaatgctttcatcaggtaaataaaatgtataatacaaactgtttatttcagctgctataatttcagctgctatactgacatttcataatttatttcctttctgtgtagccagtcataacatctttgtactctatgagcaaatagtaattttggaccttgataaaacaattttgtagagtgtaatatttctaagaggaaatgtcacaggggctatgatgcaagaaagcctcagaaatgactgcatacaggaaataatctcatcatttccaaagatgtcttcatgtcccatcaatgacatgctaccagacatatcagattccacaggataatggcaccaagctacccaagtagatgtttctggtattctagactgccgttcatgcttgtttcctaaagtatacttaaaagtttcaaatacagtttcacttagaaactgcaaccctccaagtaatgttatgtttacttaggtattaatgttatgtttacttaggtatgtatcagaggcaataatttccaaagcagatcttagaatataaccaatttgttagataactaactttatctc

SEQ ID NO: 279862 - DNA, 1874 bp, Homo sapiens
agcccggagagtgcgcgtggcggcggtggcggctgcggcaacagcggggccgatgtgtagttggtgactgcctctccagatgctgaggtgcctgtatcattggcacaggccagtgctgaaccgtaggtggagtaggctgtgccttctgaagcagtatctattcacaatgaagttgcagtctcccgaattccagtcacttttcacagaaggactgaagagtctgacagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccaggcttcatgaagaaaattttgagattactacactacggattgatgtcaccactgatggaagacatgctgaggtagaatttacaactgactggcagaaagatgcggaacgcagagatctcactataaattctatgtttttaggttttgatggcactttatttgactactttaatggttatgaagatttaaaaaataagaaagttagatttgttggacatgctaaacagagaatacaagaggattatcttagaattttaagatacttcaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtaaccatgtaaatcatttgattcaccttatctatgatcttgatgtggctccttatataggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcgaaagaggagaaaaaccttggcttatttatagttaaaaataggaaagatttaattaaagcaacagatagttcagacccattgaaaccctatcaagacttcattatagattctagggaacctgatgcaactactcgtgtatgtgaactactgaagtaccaaggagagcactgtctcctaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcatttctgccagtcataacatctttgtactctatgagcaaatagtaattttggaccttgataaaacaattttgtagagtgtaatatttctaagaggaaatgtcacaggggctatgatgcaagaaagcctcagaaatgactgcatacaggaaataatctcatcatttccaaagatgtcttcatgtcccatcaatgacatgctaccagacatatcagattccacaggataatggcaccaagctacccaagtagatgtttctggtattctagactgccgttcatgcttgtttcctaaagtatacttaaaagtttcaaatacagtttcacttagaaactgcaaccctccaagtaatgttatgtttacttaggtattaatgttatgtttacttaggtatgtatcagaggcaataatttccaaagcagatcttagaatataaccaatttgttagataactaactttatctc

SEQ ID NO: 279863 - DNA, 2909 bp, Homo sapiens
cgactcagaattacagagctttccagagcttatataccttatgtgtagttggtgactgcctctccagatgctgaggtgcctgtatcattggcacaggccagtgctgaaccgtaggtggagtaggctgtgccttctgaagcagtatctattcacaatgaagttgcagtctcccgaattccagtcacttttcacagaaggactgaagagtctgacagataaggtcttgctctgtcacccaggctggagtgcagtggcacgatcatagctcaccgcagccttgaactcctgggctcaagccatcctcccacctcagcctcccaagtagctgggactacagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccaggcttcatgaagaaaattttgagattactacactacggattgatgtcaccactgatggaagacatgctgaggtagaatttacaactgactggcagaaagatgcggaacgcagagatctcactataaattctatgtttttaggttttgatggcactttatttgactactttaatggttatgaagatttaaaaaataagaaagttagatttgttggacatgctaaacagagaatacaagaggattatcttagaattttaagatacttcaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtaaccatgtaaatcatttgattcaccttatctatgatcttgatgtggctccttatataggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcgaaagaggagaaaaaccttggcttatttatagttaaaaataggaaagatttaattaaagcaacagatagttcagacccattgaaaccctatcaagacttcattatagattctagggaacctgatgcaactactcgtgtatgtgaactactgaagtaccaaggagagcactgtctcctaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcatttctggtaagactaaattttctcccctccctcttaatgaggttttagagactacaccagaataaaagacagtttaggggacctctgtagaacaacaagggtcttattttgtgaattatatatttcaagaactaaacagagatccacctttctggatctgatttatatcactgaaatgtacagttcttttggaatagtttcacctgagaaaacatagttggctattatctatcttaacctgttcaggcttttaaaaaaaactgtttttgcatagggtagtactaagatcttaaaaagtggtaactgtcttgaagaaaaaacgtttattgtttgtttgcaattgaaataacagggttaccttaacaatgactgtctatgatgtgtcagttcttatctgaattccaaaataaacctgtgcttaaaaaagaaataattgaccaagtaagtttgcataaaatgtgaatactaaatgtgtccccagttgctggcattcatatgtacaggatttgttctagcaagctatgcttcagtatgtggttgatatttttctgtcacaatgatttctttatgcatgcagagcctgggaaagtcatgggattaacttgagggtcactattgagcctattaattaattaattattgttttaataaaacaaacattggtattggaagataaatatgtttatgtggtatctgacaatgtgtattaggtgtcatatacaatggtaatatgcctgtctttaaagtgttattttattaattaaaaggatatggctattattatatattctctaaagatttattctctaaagatttgagtcctaaatgctttcatcaggtaaataaaatgtataatacaaactgtttatttcagctgctataatttcagctgctatactgacatttcataatttatttcctttctgtgtagccagtcataacatctttgtactctatgagcaaatagtaattttggaccttgataaaacaattttgtagagtgtaatatttctaagaggaaatgtcacaggggctatgatgcaagaaagcctcagaaatgactgcatacaggaaataatctcatcatttccaaagatgtcttcatgtcccatcaatgacatgctaccagacatatcagattccacaggataatggcaccaagctacccaagtagatgtttctggtattctagactgccgttcatgcttgtttcctaaagtatacttaaaagtttcaaatacagtttcacttagaaactgcaaccctccaagtaatgttatgtttacttaggtattaatgttatgtttacttaggtatgtatcagaggcaataatttccaaagcagatcttagaatataaccaatttgttagataactaactttatctc

SEQ ID NO: 279864 - DNA, 646 bp, Homo sapiens
agcccggagagtgcgcgtggcggcggtggcggctgcggcaacagcggggccgatgtgtagttggtgactgcctctccagatgctgaggtgcctgtatcattggcacaggccagtgctgaaccgtaggtggagtaggctgtgccttctgaagcagtatctattcacaatgaagttgcagtctcccgaattccagtcacttttcacagaaggactgaagagtctgacagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccaggcttcatgaagaaaattttgagattactacactacggattgatgtcaccactgatggaagacatgctgaggtagaatttacaactgactggcagaaagatgcggaacgcagagatctcactataaattctatgtttttaggtaatatttgcagataaaaccatattgtgagtctatcagaatgccttcttttcaagtaaaacctacattctggaaatgttcttcaa

SEQ ID NO: 279865 - DNA, 829 bp, Homo sapiens
agcggacgggggcgcggctgcgtgagaggcgcgcggcggcgcagtgaacagtctccttccacaaaaccatggcgtcgctcaaatgtagcaccgtcgtctgcgtgatctgcttggagaagcccaaataccgctgtccagcctgccgcgtgccctaaacagtgcaaccctgaaactcgtcctgttgagaaaaaaataagatcagctcttcctaccaaaaccgtaaagcctgtggaaaacaaaggaggaagaagacagagtttctttgcagaatttaaagaatttagatggactctcgtcctgtcacccaggctggagtgcagcggcgcaatctcggctcactgcaacctctccctcccagattcaagcaattctcatgcctcagcctcccgagcagctgggactacaggcgcctgccactacgcccaaccaatttttgtatttttagtagagatggggtttcgccatgttggccaggctggtcttgaactcctgacctcaggtgatacacccgcctcgacttcccaaagtactgggattataggcgtgagccaccgctccaggccctaagctaaactttcatcacctcctgttcctgactcatctaaagccttggttctcacagtgtggttcatggagcatcagaatcagctgggagcttgctagaaacgcagcattgcattggaaatgggactagaagatttagagatgctgaaataattagaacgcagtttttaaaaagataaagggctctggaagattcccagttataacaaaataaataatccaaacctgcagctgatggggacatgcagccctctggtttacccag

SEQ ID NO: 279866 - DNA, 932 bp, Homo sapiens
cggacgcgtgggtcgacccacgcgtccgcgtcgctcaaatgtagcaccgtcgtctgcgtgatctgcttggagaagcccaaataccgctgtccagcctgccgcgtgccctactgctcggtagtctgcttccggaagcacaaagaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgattctactgtacattgcattattcataatttaattgtttgaaattacattaaataaatcaactaattaaaaaacaaaaaaggggggccggttaaatatc

SEQ ID NO: 279867 - DNA, 944 bp, Homo sapiens
agcggacgggggcgcggctgcgtgagaggcgcgcggcggcgcagtgaacagtctccttccacaaaaccatggcgtcgctcaaatgtagcaccgtcgtctgcgtgatctgcttggagaagcccaaataccgctgtccagcctgccgcgtgccctaaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgattctactgtacattgcattattcataatttaattgtttgaaattacattaaataaatcaactaattaaaaaacaaaaaaggggggccggttaaatatc

SEQ ID NO: 279868 - DNA, 922 bp, Homo sapiens
agcggacgggggcgcggctgcgtgagaggcgcgcggcggcgcagtgaacagtctccttccacaaaaccatggcgtcgctcaaatgtagcaccgtcgtctgcgtgatctgcttggagaagcccaaataccgctgtccagcctgccgcgtgccctactgctcggtagtctgcttccggaagcacaaagaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgattctactgtacattgcattattcataatttaattgtttgaaattacattaaataaatcaactaattaaaaaacaaaaaaggggggccggttaaatatc

SEQ ID NO: 279869 - DNA, 870 bp, Homo sapiens
agcggacgggggcgcggctgcgtgagaggcgcgcggcggcgcagtgaacagtctccttccacaaaaccatggcgtcgctcaaatgtagcaccgtcgtctgcgtgatctgcttggagaagcccaaataccgctgtccagcctgccgcgtgccctaaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaaaaaaaaaaagggggggcgccaaaatatcc

SEQ ID NO: 279870 - DNA, 938 bp, Homo sapiens
agcggacgggggcgcggctgcgtgagaggcgcgcggcggcgcagtgaacagtctccttccacaaaaccatggcgtcgctcaaatgtagcaccgtcgtctgcgtgatctgcttggagaagcccaaataccgctgtccagcctgccgcgtgccctactgctcggtagtctgcttccggaagcacaaagaacagtgcaaccctgaaactcgtcctgttgagaaaaaaataagatcagctcttcctaccaaaaccgtaaagcctgtggaaaacaaaggaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgattctactgtacattgcattattcataatttaattgtttgaaattacattaaataaatcaactaattaaaaaacaaaaaaggggggccggttaaatatc

SEQ ID NO: 279871 - DNA, 862 bp, Homo sapiens
cggacgcgtgggtcgacccacgcgtccgcgtcgctcaaatgtagcaccgtcgtctgcgtgatctgcttggagaagcccaaataccgctgtccagcctgccgcgtgccctaaacagtgcaaccctgaaactcgtcctgttgagaaaaaaataagatcagctcttcctaccaaaaccgtaaagcctgtggaaaacaaaggaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgattctactgtacattgcattattcataatttaattgtttgaaattacattaaataaatcaactaattaaaaaacaaaaaaggggggccggttaaatatc

SEQ ID NO: 279872 - DNA, 988 bp, Homo sapiens
tgcagccttgacacactgggcttaagggatcctcctgcctcagcctcccaagtagctgagaccacatgtgtgtaccaccatgcctggatgattttttttattttctgtagagacatagtcttgctaggttgcccaggctggtctcaaactcctgggctcaagtgatcctcccaccttggcctccgaatgttaggattacaggcgtgagccagcacagctggccttctgttgactctaacagtgcaaccctgaaactcgtcctgttgagaaaaaaataagatcagctcttcctaccaaaaccgtaaagcctgtggaaaacaaaggaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgattctactgtacattgcattattcataatttaattgtttgaaattacattaaataaatcaactaattaaaaaacaaaaaaggggggccggttaaatatc

SEQ ID NO: 279873 - DNA, 899 bp, Homo sapiens
agcggacgggggcgcggctgcgtgagaggcgcgcggcggcgcagtgaacagtctccttccacaaaaccatggcgtcgctcaaatgtagcaccgtcgtctgcgtgatctgcttggagaagcccaaataccgctgtccagcctgccgcgtgccctactgctcggtagtctgcttccggaagcacaaagaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttagatggactctcgtcctgtcacccaggctggagtgcagcggcgcaatctcggctcactgcaacctctccctcccagattcaagcaattctcatgcctcagcctcccgagcagctgggactacaggcgcctgccactacgcccaaccaatttttgtatttttagtagagatggggtttcgccatgttggccaggctggtcttgaactcctgacctcaggtgatacacccgcctcgacttcccaaagtactgggattataggcgtgagccaccgctccaggccctaagctaaactttcatcacctcctgttcctgactcatctaaagccttggttctcacagtgtggttcatggagcatcagaatcagctgggagcttgctagaaacgcagcattgcattggaaatgggactagaagatttagagatgctgaaataattagaacgcagtttttaaaaagataaagggctctggaagattcccagttataacaaaataaataatccaaacctgcagctgatggggacatgcagccctctggtttacccag

SEQ ID NO: 279874 - DNA, 976 bp, Homo sapiens
agcggacgggggcgcggctgcgtgagaggcgcgcggcggcgcagtgaacagtctccttccacaaaaccatggcgtcgctcaaatgtagcaccgtcgtctgcgtgatctgcttggagaagcccaaataccgctgtccagcctgccgcgtgccctactgctcggtagtctgcttccggaagcacaaagaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgattctactgtacattgcattattcataatttaattgtttgaaattacattaaataaatcaactaattaaaaaacaaaaaaggggggccggttaaatatc

SEQ ID NO: 279875 - DNA, 764 bp, Homo sapiens
cggacgcgtgggtcgacccacgcgtccgcgtcgctcaaatgtagcaccgtcgtctgcgtgatctgcttggagaagcccaaataccgctgtccagcctgccgcgtgccctactgctcggtagtctgcttccggaagcacaaaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgattctactgtacattgcattattcataatttaattgtttgaaattacattaaataaatcaactaattaaaaaacaaaaaaggggggccggttaaatatc

SEQ ID NO: 279876 - DNA, 2932 bp, Homo sapiens
gtatctgactcaggacctgatttaaggtttggggttttttggccctttgtttcttcctcttgttttttgacctttagttactccacacctcattagttccttgacctgcaggtggactgagaagagagccatgcaggtagcaggcaagagtgtggttatcgttggaccaggattcaggatctgactgagtagctgactcttaatccagtttgtgttgatcaccaggaggatctggacctcagtattaccacatctagagctataatcacatccctgttaagccttcctgagatcacaccaaatgtccttgatgggaattgtaaacaacccttacttctggtttctaatgatattccaggaaaggagcctaactagagtcagtgatatgccaactccacctttgccttccaccatgtttggaagctccctgaggcctcaccaggagcagatgctcgtcccatgcttcctataagcctgcagaactgtgagccataataaactgtgaattataaattgcctttatagcaatgcaaatggaccagtacagatgggatgctgggaagacagttgtttccaccttcagtaaagtccgtggaacacagttgtgactatattctaggccagccaagatgcttgtactcagaaaggagtggtctcaggaccataagaaagtgaaaaaataaaaataagaaaataaagaagggattgtcaatgaatcagaattcatcaaggtcaaagtcttaggaaattccttcatgaggaagtctaggggggctatggaaatgaaatttttaaacaaataggtatgtggtgctggcaggaataaattatggacttatgaatataacataagattctttattacctggtctcacccgtctttccacctctgccccccttcttgcccgactctgtgtatcacccataataaactacttacagcttcctagtgttaaatttaccctaaagctgcctccttcaatattttaagtttaacctaaaggttcttcatacatagtgaactataacccaatgattaaacagattgtaacctactcttgtaccagtcaccaagtttcagccaatcagaggtggccaactgttcaaaccatgctcaaataagggaaatgtcatggtgtaactaatccagctgtttctataccttacttctgttttcttaggtcactttccttttttgtccataaattctctccaaccactcagcagcactggagtcactccaaagctatcctggttcaggggtctgtctgattcacaagtcattctttgttcaattgagctctgctaaatttaatttgtctgaagtttttcttttaacagatggtgtcagaaatggaccccaaagtagagctcccagtgatcccccaggagcactgagtgaccacaaggggtacctgctgggcccgtcctctcgcagtgtccactgctctcttacagcaactggagattgtggctgcattctctctcagattctgaagctccatacattgccgttttcagctgttcaagcttgcttgagcaaatttttgatcttagctgagtttggaagtcgatagacattggactgggtccaggatttgattggatctgataattaactggcttggatccagttagatgcctcgggtatctgactgggtcagatagaaaccgccagtaaatattttaataacaatactgcaggggtatgaactctggctttaagaaactcacaaggaattttatgttctataccctttgtttctttttcttgtgtgcttcggtcaggaaaaatcattagtcaagttaatcaaggggatctgagagccaaatacaagattcaacgtaaaaatggaatccttgggctaggcgtggtggctcaggcctgtaatcccaggactttgggaggctgaggcaggcggatcacctgaccttaggagttcgagaccagtctggccaacatggtgaaaccccgtctccactaaaaatacaaaaattagccaggcgtggtggtgggcacctgtaatcccagctactttggaggctgaggcaggataatcacttgaacccaggaggcagaggttgcagtgatctgagattgcaccactgcactccagcctgggcaaaagagcgagactccatctcataaataaatacataaataaataaagaaatccttaatttctgcggaactgagtgctctaccttctggctacacctacgtatacctgtatgaggtataggccctggaagcagcaaacacttacagaaatggtgaaatcttactaaaggtaatctaaagttatggtggaacatcccaaatgaacaacactgcactttaggaagtacatataaaaatgaagtctcccaatttagtattattcagggatggctgttgaagttcagaagcttctaaaaagattccaataattttacagattcttttaaaagattctttgtaaaaggcaaataaaaagcttaagtgactaatcagaaaaattaggtcttctaaccttttgtcattgttactgtcttgccctgaaagggaaaaggaaagctggataaagtatttatagaagatagaggacctgtggtggctcatgcctgtaatccaaggtggaaggattgcttgaggccagaagttcaagaccagtccaagcaacatagcaaggccccatctctacaaaaaatgaaaataaaattagccgagcgtgatggctcatgcctgtagttctagcttctagagaggctgaggcaggaggattgcttgagtccaggagttcaagattacagtgagctatggtcacaccactgcactccagcctgggtgatggagtgagactgtctcaataaaaagacaaaaaggtaagcccttaggtaaagtaagcttgcttctttgttagagctatccatgctgagtccaggcaaagaa

SEQ ID NO: 279877 - DNA, 2933 bp, Homo sapiens
gcggccgcccagcgcccgtccccgcgccgcactccccggcactccccggcgctccccgcgccgcgcgccccgcaccggctggaggccccggccccccggcgttccctctccgcgcacctcccggcccgcgctagcaggtagcaggcaagagtgtggttatcgttggaccaggattcaggatctgactgagtagctgactcttaatccagtttgtgttgatcaccaggaggatctggacctcagtattaccacatctagagctataatcacatccctgttaagccttcctgagatcacaccaaatgtccttgatgggaattgtaaacaacccttacttctggtttctaatgatattccaggaaaggagcctaactagagtcagtgatatgccaactccacctttgccttccaccatgtttggaagctccctgaggcctcaccaggagcagatgctcgtcccatgcttcctataagcctgcagaactgtgagccataataaactgtgaattataaattgcctttatagcaatgcaaatggaccagtacagatgggatgctgggaagacagttgtttccaccttcagtaaagtccgtggaacacagttgtgactatattctaggccagccaagatgcttgtactcagaaaggagtggtctcaggaccataagaaagtgaaaaaataaaaataagaaaataaagaagggattgtcaatgaatcagaattcatcaaggtcaaagtcttaggaaattccttcatgaggaagtctaggggggctatggaaatgaaatttttaaacaaataggtatgtggtgctggcaggaataaattatggacttatgaatataacataagattctttattacctggtctcacccgtctttccacctctgccccccttcttgcccgactctgtgtatcacccataataaactacttacagcttcctagtgttaaatttaccctaaagctgcctccttcaatattttaagtttaacctaaaggttcttcatacatagtgaactataacccaatgattaaacagattgtaacctactcttgtaccagtcaccaagtttcagccaatcagaggtggccaactgttcaaaccatgctcaaataagggaaatgtcatggtgtaactaatccagctgtttctataccttacttctgttttcttaggtcactttccttttttgtccataaattctctccaaccactcagcagcactggagtcactccaaagctatcctggttcaggggtctgtctgattcacaagtcattctttgttcaattgagctctgctaaatttaatttgtctgaagtttttcttttaacagatggtgtcagaaatggaccccaaagtagagctcccagtgatcccccaggagcactgagtgaccacaaggggtacctgctgggcccgtcctctcgcagtgtccactgctctcttacagcaactggagattgtggctgcattctctctcagattctgaagctccatacattgccgttttcagctgttcaagcttgcttgagcaaatttttgatcttagctgagtttggaagtcgatagacattggactgggtccaggatttgattggatctgataattaactggcttggatccagttagatgcctcgggtatctgactgggtcagatagaaaccgccagtaaatattttaataacaatactgcaggggtatgaactctggctttaagaaactcacaaggaattttatgttctataccctttgtttctttttcttgtgtgcttcggtcaggaaaaatcattagtcaagttaatcaaggggatctgagagccaaatacaagattcaacgtaaaaatggaatccttgggctaggcgtggtggctcaggcctgtaatcccaggactttgggaggctgaggcaggcggatcacctgaccttaggagttcgagaccagtctggccaacatggtgaaaccccgtctccactaaaaatacaaaaattagccaggcgtggtggtgggcacctgtaatcccagctactttggaggctgaggcaggataatcacttgaacccaggaggcagaggttgcagtgatctgagattgcaccactgcactccagcctgggcaaaagagcgagactccatctcataaataaatacataaataaataaagaaatccttaatttctgcggaactgagtgctctaccttctggctacacctacgtatacctgtatgaggtataggccctggaagcagcaaacacttacagaaatggtgaaatcttactaaaggtaatctaaagttatggtggaacatcccaaatgaacaacactgcactttaggaagtacatataaaaatgaagtctcccaatttagtattattcagggatggctgttgaagttcagaagcttctaaaaagattccaataattttacagattcttttaaaagattctttgtaaaaggcaaataaaaagcttaagtgactaatcagaaaaattaggtcttctaaccttttgtcattgttactgtcttgccctgaaagggaaaaggaaagctggataaagtatttatagaagatagaggacctgtggtggctcatgcctgtaatccaaggtggaaggattgcttgaggccagaagttcaagaccagtccaagcaacatagcaaggccccatctctacaaaaaatgaaaataaaattagccgagcgtgatggctcatgcctgtagttctagcttctagagaggctgaggcaggaggattgcttgagtccaggagttcaagattacagtgagctatggtcacaccactgcactccagcctgggtgatggagtgagactgtctcaataaaaagacaaaaaggtaagcccttaggtaaagtaagcttgcttctttgttagagctatccatgctgagtccaggcaaagaa

SEQ ID NO: 279878 - DNA, 3502 bp, Homo sapiens
cgcgggggcgcccccctcggccgggcgctcgggtttcagccgccgctcctccgcgccccgcccgcgcctggcccgctcgccggcgccgggagagacctcgtaacggaactgggacgccagcgctgcattgtgggagcttttaaagcggcggggagctcggcgcgaccctcgggcccaccgggccacgctcgcccggcccgcgacgcccccccgctgtcgcctggcccgcgacgcaccgaggcctgaggacccgaaagccgggcgcggggagatgaccggtggctcgtgacggtcccacgggcaaaatcttccatcgcccggggctgagacttgtcaaactgccctctacggtcacccggaaagtaggaggctttttctgcagaggggaaaaaaatcaaaaagagccgttccatcccccctccaaggactgggtttgaattgcttttcatctgcagtggctgtgattcagcgtccctcttagcagcaggcaatgacagaggcaggagaggggaaaaaaaaaaagaaagaaagaaaaaacacagcaaatgaatcaaacggacgtgagtaacaaaagtttagaaagagctgggctcgtattcagaaaaaacgcctcatccccccgccccgctgcactcccaacccctttaaaaatagcagataatcaagaaaggaaacgggtgctttcatatggaaatacagatgtcaggtagcaggcaagagtgtggttatcgttggaccaggattcaggatctgactgagtagctgactcttaatccagtttgtgttgatcaccaggaggatctggacctcagtattaccacatctagagctataatcacatccctgttaagccttcctgagatcacaccaaatgtccttgatgggaattgtaaacaacccttacttctggtttctaatgatattccaggaaaggagcctaactagagtcagtgatatgccaactccacctttgccttccaccatgtttggaagctccctgaggcctcaccaggagcagatgctcgtcccatgcttcctataagcctgcagaactgtgagccataataaactgtgaattataaattgcctttatagcaatgcaaatggaccagtacagatgggatgctgggaagacagttgtttccaccttcagtaaagtccgtggaacacagttgtgactatattctaggccagccaagatgcttgtactcagaaaggagtggtctcaggaccataagaaagtgaaaaaataaaaataagaaaataaagaagggattgtcaatgaatcagaattcatcaaggtcaaagtcttaggaaattccttcatgaggaagtctaggggggctatggaaatgaaatttttaaacaaataggtatgtggtgctggcaggaataaattatggacttatgaatataacataagattctttattacctggtctcacccgtctttccacctctgccccccttcttgcccgactctgtgtatcacccataataaactacttacagcttcctagtgttaaatttaccctaaagctgcctccttcaatattttaagtttaacctaaaggttcttcatacatagtgaactataacccaatgattaaacagattgtaacctactcttgtaccagtcaccaagtttcagccaatcagaggtggccaactgttcaaaccatgctcaaataagggaaatgtcatggtgtaactaatccagctgtttctataccttacttctgttttcttaggtcactttccttttttgtccataaattctctccaaccactcagcagcactggagtcactccaaagctatcctggttcaggggtctgtctgattcacaagtcattctttgttcaattgagctctgctaaatttaatttgtctgaagtttttcttttaacagatggtgtcagaaatggaccccaaagtagagctcccagtgatcccccaggagcactgagtgaccacaaggggtacctgctgggcccgtcctctcgcagtgtccactgctctcttacagcaactggagattgtggctgcattctctctcagattctgaagctccatacattgccgttttcagctgttcaagcttgcttgagcaaatttttgatcttagctgagtttggaagtcgatagacattggactgggtccaggatttgattggatctgataattaactggcttggatccagttagatgcctcgggtatctgactgggtcagatagaaaccgccagtaaatattttaataacaatactgcaggggtatgaactctggctttaagaaactcacaaggaattttatgttctataccctttgtttctttttcttgtgtgcttcggtcaggaaaaatcattagtcaagttaatcaaggggatctgagagccaaatacaagattcaacgtaaaaatggaatccttgggctaggcgtggtggctcaggcctgtaatcccaggactttgggaggctgaggcaggcggatcacctgaccttaggagttcgagaccagtctggccaacatggtgaaaccccgtctccactaaaaatacaaaaattagccaggcgtggtggtgggcacctgtaatcccagctactttggaggctgaggcaggataatcacttgaacccaggaggcagaggttgcagtgatctgagattgcaccactgcactccagcctgggcaaaagagcgagactccatctcataaataaatacataaataaataaagaaatccttaatttctgcggaactgagtgctctaccttctggctacacctacgtatacctgtatgaggtataggccctggaagcagcaaacacttacagaaatggtgaaatcttactaaaggtaatctaaagttatggtggaacatcccaaatgaacaacactgcactttaggaagtacatataaaaatgaagtctcccaatttagtattattcagggatggctgttgaagttcagaagcttctaaaaagattccaataattttacagattcttttaaaagattctttgtaaaaggcaaataaaaagcttaagtgactaatcagaaaaattaggtcttctaaccttttgtcattgttactgtcttgccctgaaagggaaaaggaaagctggataaagtatttatagaagatagaggacctgtggtggctcatgcctgtaatccaaggtggaaggattgcttgaggccagaagttcaagaccagtccaagcaacatagcaaggccccatctctacaaaaaatgaaaataaaattagccgagcgtgatggctcatgcctgtagttctagcttctagagaggctgaggcaggaggattgcttgagtccaggagttcaagattacagtgagctatggtcacaccactgcactccagcctgggtgatggagtgagactgtctcaataaaaagacaaaaaggtaagcccttaggtaaagtaagcttgcttctttgttagagctatccatgctgagtccaggcaaagaa

SEQ ID NO: 279879 - DNA, 1279 bp, Homo sapiens
cgcgggggcgcccccctcggccgggcgctcgggtttcagccgccgctcctccgcgccccgcccgcgcctggcccgctcgccggcgccgggagagacctcgtaacggaactgggacgccagcgctgcattgtgggagcttttaaagcggcggggagctcggcgcgaccctcgggcccaccgggccacgctcgcccggcccgcgacgcccccccgctgtcgcctggcccgcgacgcaccgaggcctgaggacccgaaagccgggcgcggggagatgaccggtggctcgtgacggtcccacgggcaaaatcttccatcgcccggggctgagacttgtcaaactgccctctacggtcacccggaaagtaggaggctttttctgcagaggggaaaaaaatcaaaaagagccgttccatcccccctccaaggactgggtttgaattgcttttcatctgcagtggctgtgattcagcgtccctcttagcagcaggcaatgacagaggcaggagaggggaaaaaaaaaaagaaagaaagaaaaaacacagcaaatgaatcaaacggacgtgagtaacaaaagtttagaaagagctgggctcgtattcagaaaaaacgcctcatccccccgccccgctgcactcccaacccctttaaaaatagcagataatcaagaaaggaaacgggtgctttcatatggaaatacagatgtcaggtagcaggcaagagtgtggttatcgttggaccaggattcaggatctgactgagtagctgactcttaatccagtttgtgttgatcaccaggaggatctggacctcagtattaccacatctagagctataatcacatccctgttaagccttcctgagatcacaccaaatgtccttgatgggaattgtaaacaacccttacttctggtttctaatgatattccaggaaaggagcctaactagagtcagtgatatgccaactccacctttgccttccaccatgtttggaagctccctgaggcctcaccaggagcagatgctcgtcccatgcttcctataagcctgcagaactggaaaagaaagctggataaagtatttatagaagatgagccaccacagctggccgtaaatattttttgaatttgaatctgttttggaagccaaatatgttttggaagccaaacaattaagagaagtaaaattttaaccctagtaggtttcgcagattcatccccagatatgtttttgtttggcttgtgttattaacaaataaatgagtgtctttcaaatggaaaaa

SEQ ID NO: 279880 - DNA, 3381 bp, Homo sapiens
cgcgggggcgcccccctcggccgggcgctcgggtttcagccgccgctcctccgcgccccgcccgcgcctggcccgctcgccggcgccgggagagacctcgtaacggaactgggacgccagcgctgcattgtgggagcttttaaagcggcggggagctcggcgcgaccctcgggcccaccgggccacgctcgcccggcccgcgacgcccccccgctgtcgcctggcccgcgacgcaccgaggcctgaggacccgaaagccgggcgcggggagatgaccggtggctcgtgacggtcccacgggcaaaatcttccatcgcccggggctgagacttgtcaaactgccctctacggtcacccggaaagtaggaggctttttctgcagaggggaaaaaaatcaaaaagagccgttccatcccccctccaaggactgggtttgaattgcttttcatctgcagtggctgtgattcagcgtccctcttagcagcaggcaatgacagaggcaggagaggggaaaaaaaaaaagaaagaaagaaaaaacacagcaaatgaatcaaacggacgtgagtaacaaaagtttagaaagagctgggctcgtattcagaaaaaacgcctcatccccccgccccgctgcactcccaacccctttaaaaatagcagataatcaagaaaggaaacgggtgctttcatatggaaatacagatgtcaggtagcaggcaagagtgtggttatcgttggaccaggattcaggatctgactgagtagctgactcttaatccagtttgtgttgatcaccaggaggatctggacctcagtattaccacatctagaggtgatatgccaactccacctttgccttccaccatgtttggaagctccctgaggcctcaccaggagcagatgctcgtcccatgcttcctataagcctgcagaactgtgagccataataaactgtgaattataaattgcctttatagcaatgcaaatggaccagtacagatgggatgctgggaagacagttgtttccaccttcagtaaagtccgtggaacacagttgtgactatattctaggccagccaagatgcttgtactcagaaaggagtggtctcaggaccataagaaagtgaaaaaataaaaataagaaaataaagaagggattgtcaatgaatcagaattcatcaaggtcaaagtcttaggaaattccttcatgaggaagtctaggggggctatggaaatgaaatttttaaacaaataggtatgtggtgctggcaggaataaattatggacttatgaatataacataagattctttattacctggtctcacccgtctttccacctctgccccccttcttgcccgactctgtgtatcacccataataaactacttacagcttcctagtgttaaatttaccctaaagctgcctccttcaatattttaagtttaacctaaaggttcttcatacatagtgaactataacccaatgattaaacagattgtaacctactcttgtaccagtcaccaagtttcagccaatcagaggtggccaactgttcaaaccatgctcaaataagggaaatgtcatggtgtaactaatccagctgtttctataccttacttctgttttcttaggtcactttccttttttgtccataaattctctccaaccactcagcagcactggagtcactccaaagctatcctggttcaggggtctgtctgattcacaagtcattctttgttcaattgagctctgctaaatttaatttgtctgaagtttttcttttaacagatggtgtcagaaatggaccccaaagtagagctcccagtgatcccccaggagcactgagtgaccacaaggggtacctgctgggcccgtcctctcgcagtgtccactgctctcttacagcaactggagattgtggctgcattctctctcagattctgaagctccatacattgccgttttcagctgttcaagcttgcttgagcaaatttttgatcttagctgagtttggaagtcgatagacattggactgggtccaggatttgattggatctgataattaactggcttggatccagttagatgcctcgggtatctgactgggtcagatagaaaccgccagtaaatattttaataacaatactgcaggggtatgaactctggctttaagaaactcacaaggaattttatgttctataccctttgtttctttttcttgtgtgcttcggtcaggaaaaatcattagtcaagttaatcaaggggatctgagagccaaatacaagattcaacgtaaaaatggaatccttgggctaggcgtggtggctcaggcctgtaatcccaggactttgggaggctgaggcaggcggatcacctgaccttaggagttcgagaccagtctggccaacatggtgaaaccccgtctccactaaaaatacaaaaattagccaggcgtggtggtgggcacctgtaatcccagctactttggaggctgaggcaggataatcacttgaacccaggaggcagaggttgcagtgatctgagattgcaccactgcactccagcctgggcaaaagagcgagactccatctcataaataaatacataaataaataaagaaatccttaatttctgcggaactgagtgctctaccttctggctacacctacgtatacctgtatgaggtataggccctggaagcagcaaacacttacagaaatggtgaaatcttactaaaggtaatctaaagttatggtggaacatcccaaatgaacaacactgcactttaggaagtacatataaaaatgaagtctcccaatttagtattattcagggatggctgttgaagttcagaagcttctaaaaagattccaataattttacagattcttttaaaagattctttgtaaaaggcaaataaaaagcttaagtgactaatcagaaaaattaggtcttctaaccttttgtcattgttactgtcttgccctgaaagggaaaaggaaagctggataaagtatttatagaagatagaggacctgtggtggctcatgcctgtaatccaaggtggaaggattgcttgaggccagaagttcaagaccagtccaagcaacatagcaaggccccatctctacaaaaaatgaaaataaaattagccgagcgtgatggctcatgcctgtagttctagcttctagagaggctgaggcaggaggattgcttgagtccaggagttcaagattacagtgagctatggtcacaccactgcactccagcctgggtgatggagtgagactgtctcaataaaaagacaaaaaggtaagcccttaggtaaagtaagcttgcttctttgttagagctatccatgctgagtccaggcaaagaa

SEQ ID NO: 279881 - DNA, 2896 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279882 - DNA, 1035 bp, Homo sapiens
  misc_feature (879)..(879): n is a, c, g, or t
  misc_feature (881)..(881): n is a, c, g, or t
ccaactacggctaggtacgaggcgggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaagtatgatggttctacngntgggatctggtgggggaacaatttgggggtaggaaaatcactggaaggcgagtggcaaaaaagggggggtcacagcggaaaggggaggggtggagagagcggtgctggtgagggccgggggggagaaatggaggcccggtgggggggatcctag

SEQ ID NO: 279883 - DNA, 407 bp, Homo sapiens
gcggcgcctactactactaaattcgcggccgctcgacctgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279884 - DNA, 2607 bp, Homo sapiens
tcccccccccccccccctccccccccccctccccccccccccccctcccccctccccccctcggttaggtacgaggctgggtgttttgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279885 - DNA, 3927 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtgagcgccgcgcacgcgagcagccagagggcaggaagggtggcagggctggagcaagttctcatttcggctaactacaacagcatgcccttgaaggacctgcgtctatgctgttatcctaaaaccggatgcagagggactgtctaaaccctgatgactgctgaccaagttagtggccggcagatttgggcattcgtaatgctgtccacctcgggtttgaaaggaatgaagagagctaaatgtagaaacagcgcttgagagaagccttcacgcggggattcagtgcccctagaagaggctgcgccgcttttaaccttgccgatgacggttgcttaggtgaaaagaaacgaccttttgcctctgaaagggcggtaatatgccttaaaaagagcgggctagatctcaggcagtgtattttttttttccttccaggttctaatgatagccggtgctatctgtcgaaaggacaaaatgggtttagtggttgattgccatcagcccccgagttgtctagacaatggggtattggactcagctgggtcgttcagcagtcagttcagaaagagggaactgcattggatttaaggaaaatcctctctaattccctcgaaaaagcctaatggctgttcatttttgacaagtgacgggagatggctaacctctgacacttagaaagggatcaaggaaggaaatcttatggggaagaaggccttagcaatgcttaaatttatggaaatatgattgatttccagtattatcctttgccagcagtgaactgccattctgtcacagctctgtgtctgatacaaggcacatagattctgtacttaccatccccaaattgcaatgtctcagactcaggcttagagcatggcatgaacatcaaaggcaggaacctgtttatctttgaattggcaagatacagcaaaattacactgtttggaaatacgaatagaggagtgaaaattgttgcagtggggtacccaaagggattcgagacctcaagttttttttcatcttgtatccttcaggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279886 - DNA, 3429 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctgtgagcaaagattggagctgagtacaagggattgggtacaggcaaaggaaatcaggagtagactgtcttgttatattgggtgtatgtcacttctggttcctttttccttgcctctggaagctggttgggctctagagcagccttggctggttcagaggggtcagattgagttcaatactgactggcctttgagactccaggatttcataccatcctaggcccacaaaggtatattcagaatggacctggacattcagactctatggcagcaatttgacccaacacaagatcagcctctggggtgggaataggtattttgaggcagcctatagcatctgatcccctttcaccttccctaaggaatctctttttcccaaaccctgtcaacaactcccacgtccctctgacataattccacagaacctgtatcatctcccttttgtccacccatgtcatcagtatggatttgcttggatgtccaggtataggtgaatgcttaggaatatactgcagctcccttctttcttccatagctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279887 - DNA, 3063 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtgagacctgatctatactgtgcacaggccctgaattgcatggcagtcacactgagccagaaggggcattatttccacccataatcctgtctaaaaaagttgctctcattatcaggatgcacttttcctccacaccctaatggttctgtgtttttttttccccttaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279888 - DNA, 2772 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaactgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279889 - DNA, 2781 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279890 - DNA, 3072 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacaggtgcgtcaggctgtcctcctctcgccaagatggttatctcattcccaggtcctggcccctagactctagggtggttggtttctggggctctggttgttagagctgtttatctgccgaggggagcaggagagttatgtgcacctcccccagccgatctctcctctgcttctttacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279891 - DNA, 3605 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctgtgagcaaagattggagctgagtacaagggattgggtacaggcaaaggaaatcaggagtagactgtcttgttatattgggtgtatgtcacttctggttcctttttccttgcctctggaagctggttgggctctagagcagccttggctggttcagaggggtcagattgagttcaatactgactggcctttgagactccaggatttcataccatcctaggcccacaaaggtatattcagaatggacctggacattcagactctatggcagcaatttgacccaacacaagatcagcctctggggtgggaataggtattttgaggcagcctatagcatctgatcccctttcaccttccctaaggaatctctttttcccaaaccctgtcaacaactcccacgtccctctgacataattccacagaacctgtatcatctcccttttgtccacccatgtcatcagtatggatttgcttggatgtccaggtataggtgaatgcttaggaatatactgcagctcccttctttcttccatagctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacaggtgcgtcaggctgtcctcctctcgccaagatggttatctcattcccaggtcctggcccctagactctagggtggttggtttctggggctctggttgttagagctgtttatctgccgaggggagcaggagagttatgtgcacctcccccagccgatctctcctctgcttctttacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279892 - DNA, 2088 bp, Homo sapiens
ctcaaaaaaaaaaaaaaaagaatagtacttaattctagcccactccacttcccttccacaggtggcacaactctttacagacaactttgactaccaaactcgagatgactttgtgcgaggtctcttagtgaatgaggaggtgagaaaagtcttccaatgcctctttaggagagaggagaaggctatgattgtatctcatgctggtaacttttgatcttttttgtattttattgaggcttaggagggaggaaaagcaggggacaggaggaacagtacacaaagaagaatctttgtggcagtgagaggcagaggggaacttaaaaggattagaaaagttgtacttgggggcattcttcctgtctttcttgcttaggtgacctccctttccttctcattcagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279893 - DNA, 2672 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtgagacctgatctatactgtgcacaggccctgaattgcatggcagtcacactgagccagaaggggcattatttccacccataatcctgtctaaaaaagttgctctcattatcaggatgcacttttcctccacaccctaatggttctgtgtttttttttccccttaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279894 - DNA, 1551 bp, Homo sapiens
gctaggaggaggcctggtgttaatcggccgaggcggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279895 - DNA, 1853 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279896 - DNA, 1958 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtgagcgccgcgcacgcgagcagccagagggcaggaagggtggcagggctggagcaagttctcatttcggctaactacaacagcatgcccttgaaggacctgcgtctatgctgttatcctaaaaccggatgcagagggactgtctaaaccctgatgactgctgaccaagttagtggccggcagatttgggcattcgtaatgctgtccacctcgggtttgaaaggaatgaagagagctaaatgtagaaacagcgcttgagagaagccttcacgcggggattcagtgcccctagaagaggctgcgccgcttttaaccttgccgatgacggttgcttaggtgaaaagaaacgaccttttgcctctgaaagggcggtaatatgccttaaaaagagcgggctagatctcaggcagtgtattttttttttccttccaggttctaatgatagccggtgctatctgtcgaaaggacaaaatgggtttagtggttgattgccatcagcccccgagttgtctagacaatggggtattggactcagctgggtcgttcagcagtcagttcagaaagagggaactgcattggatttaaggaaaatcctctctaattccctcgaaaaagcctaatggctgttcatttttgacaagtgacgggagatggctaacctctgacacttagaaagggatcaaggaaggaaatcttatggggaagaaggccttagcaatgcttaaatttatggaaatatgattgatttccagtattatcctttgccagcagtgaactgccattctgtcacagctctgtgtctgatacaaggcacatagattctgtacttaccatccccaaattgcaatgtctcagactcaggcttagagcatggcatgaacatcaaaggcaggaacctgtttatctttgaattggcaagatacagcaaaattacactgtttggaaatacgaatagaggagtgaaaattgttgcagtggggtacccaaagggattcgagacctcaagttttttttcatcttgtatccttcaggtcctcttgcccctggccaatgtggcattaattgactacactctggaattcctgactgccacaggtgtacaggaaacatttgtcttttgttgctggaaagctgctcaaatcaaagaacatttactgtaaggccctgcaacttttctttccatgtttcgccatctttttccagttttttcaggatgaatgtaactaaggggaaatgtgagaggggaaaaatgtgtctacttagatgtcattgtaagttctaagggtattttctacacttatcaggaggtgagcagctgaaactttgtatctgtctgtcttgggttttctgtgacaaagattaaagaataaacttgggttttttctgaatctcattataa

SEQ ID NO: 279897 - DNA, 128 bp, Homo sapiens
gtcaggatgggaaaatgacaggaacaagggttaaagaccagcagagccctgagactgcttttttgcagttctgtccctcctgtcctttataggttgagacggaagctagaaaaaaatgtttctgtgat

SEQ ID NO: 279898 - DNA, 499 bp, Homo sapiens
ctcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgagcacaggtggggaatcaagccaactatcctaggaacaggaacctgggggggccacgtctccagaaacacaagggatggctacacaagggacagtccctgggaataaggaactatagagcggctacctcaggaaaggaggaaacagggatttgaaaacagcgataccttaatttgtagcctgtgggcctctcattggatgactcttcacattccagggtaccctgtagtcacattcaggagcaagtagataattaac

SEQ ID NO: 279899 - DNA, 927 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgtaaggccctgcaacttttctttccatgtttcgccatctttttccagttttttcaggatgaatgtaactaaggggaaatgtgagaggggaaaaatgtgtctacttagatgtcattgtaagttctaagggtattttctacacttatcaggaggtgagcagctgaaactttgtatctgtctgtcttgggttttctgtgacaaagattaaagaataaacttgggttttttctgaatctcattataa

SEQ ID NO: 279900 - DNA, 3195 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtaagagcagcccctccctgttctcctcggggtgatcccgggaaggtagaggctttctcgtaagtgttttgtctccaaataggaacctattccttcgacatcccaaatggaaagaccagtagtatttggagcagggagagcattattaagttctagcctcagcatagactttctccttcctaaaccctccccttccatattgttccatccagattcctctccaatgtctatcaaagtcatagttctaagcctgctgaaaggccagtgaaggccctggtgtcaccccagtctccccacaggtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279901 - DNA, 3728 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtaagagcagcccctccctgttctcctcggggtgatcccgggaaggtagaggctttctcgtaagtgttttgtctccaaataggaacctattccttcgacatcccaaatggaaagaccagtagtatttggagcagggagagcattattaagttctagcctcagcatagactttctccttcctaaaccctccccttccatattgttccatccagattcctctccaatgtctatcaaagtcatagttctaagcctgctgaaaggccagtgaaggccctggtgtcaccccagtctccccacaggtatgcctataacataagtctaaaggaggtgatgcaggtactgagccacgtggtcctggagttccccctgcaacagatggattccccgcttgactcaagccgctactgtgccctgctgcttcctgtgagcaaagattggagctgagtacaagggattgggtacaggcaaaggaaatcaggagtagactgtcttgttatattgggtgtatgtcacttctggttcctttttccttgcctctggaagctggttgggctctagagcagccttggctggttcagaggggtcagattgagttcaatactgactggcctttgagactccaggatttcataccatcctaggcccacaaaggtatattcagaatggacctggacattcagactctatggcagcaatttgacccaacacaagatcagcctctggggtgggaataggtattttgaggcagcctatagcatctgatcccctttcaccttccctaaggaatctctttttcccaaaccctgtcaacaactcccacgtccctctgacataattccacagaacctgtatcatctcccttttgtccacccatgtcatcagtatggatttgcttggatgtccaggtataggtgaatgcttaggaatatactgcagctcccttctttcttccatagctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279902 - DNA, 2867 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctgaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279903 - DNA, 2972 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgtaaaaaaaaaaaaccaaatcaaacccgcaaccactacaaagcagacaacagcaaaaagcacgacctcaaacagagagg

SEQ ID NO: 279904 - DNA, 3043 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagcatggcgctgccgttctccactacggtacacgcatgaccatctggtccggacgtgcttgatatctgaacattacctgagtagtgaggtatttccactaacctctgagttgagacggaacgccatcaacaagagcctgtccttatcataaccgcacaacgttacacctgagacgggaactcatctaccgccgtggcgccctggaatggccttcgatctgccctggtggtttaggccttc

SEQ ID NO: 279905 - DNA, 3156 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggaggtgagaaaagtcttccaatgcctctttaggagagaggagaaggctatgattgtatctcatgctggtaacttttgatcttttttgtattttattgaggcttaggagggaggaaaagcaggggacaggaggaacagtacacaaagaagaatctttgtggcagtgagaggcagaggggaacttaaaaggattagaaaagttgtacttgggggcattcttcctgtctttcttgcttaggtgacctccctttccttctcattcagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279906 - DNA, 2505 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279907 - DNA, 1401 bp, Homo sapiens
ccaactacggctaggtacgaggcgggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279908 - DNA, 1227 bp, Homo sapiens
  misc_feature (15)..(15): n is a, c, g, or t
tacgtcgataccccncgggtattgtagcgaggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgta

SEQ ID NO: 279909 - DNA, 1263 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtgagcgccgcgcacgcgagcagccagagggcaggaagggtggcagggctggagcaagttctcatttcggctaactacaacagcatgcccttgaaggacctgcgtctatgctgttatcctaaaaccggatgcagagggactgtctaaaccctgatgactgctgaccaagttagtggccggcagatttgggcattcgtaatgctgtccacctcgggtttgaaaggaatgaagagagctaaatgtagaaacagcgcttgagagaagccttcacgcggggattcagtgcccctagaagaggctgcgccgcttttaaccttgccgatgacggttgcttaggtcctcttgcccctggccaatgtggcattaattgactacactctggaattcctgactgccacaggtgtacaggaaacatttgtcttttgttgctggaaagctgctcaaatcaaagaacatttactgtaaggccctgcaacttttctttccatgtttcgccatctttttccagttttttcaggatgaatgtaactaaggggaaatgtgagaggggaaaaatgtgtctacttagatgtcattgtaagttctaagggtattttctacacttatcaggaggtgagcagctgaaactttgtatctgtctgtcttgggttttctgtgacaaagattaaagaataaacttgggttttttctgaatctcattataa

SEQ ID NO: 279910 - DNA, 2348 bp, Homo sapiens
gagaggtgtagcagaaagcagtgccccaggcctccacgcgacggtgaagcaggaaccaggggctgccagcagagcagcccaggtgcgtcgccttagggacagagctgccaagtgccgagctggggctgccagagccgagccgggaacggcatttgccagagccgaggcggaagccggagcatttgggggacgggaccgcgggaacccggaaacgcctgggctgcaccgagctggcggtggctacggcgacgggagccggcggcgctgcgggtcagcggtcgcgtaggacccagcggactcggcagcctggggcgcccggcggagctgaaccgcggcccccggtggtgggctcagccggtcgagctgcgcgggaggcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacatttatgatggagaactggtatcaaagaatggattttttcagggatataaccgactgacctggatagtagttgttcttcaggcacttggaggccttgtaatagctgctgttattaagtatgcagataatattttaaaaggatttgcaacctctttatcgataatattatcaacattgatctcctatttttggcttcaagattttgtgccaaccagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactcattg

SEQ ID NO: 279911 - DNA, 2033 bp, Homo sapiens
ccagttgaaaagatttattctgaaagactcttgccttctcaggcctttggttagagaaagcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacatttatgatggagaactggtatcaaagaatggattttttcagggatataaccgactgacctggatagtagttgttcttcaggcacttggaggccttgtaatagctgctgttattaagtatgcagataatattttaaaaggatttgcaacctctttatcgataatattatcaacattgatctcctatttttggcttcaagattttgtgccaaccagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactcattg

SEQ ID NO: 279912 - DNA, 2294 bp, Homo sapiens
gagaggtgtagcagaaagcagtgccccaggcctccacgcgacggtgaagcaggaaccaggggctgccagcagagcagcccaggtgcgtcgccttagggacagagctgccaagtgccgagctggggctgccagagccgagccgggaacggcatttgccagagccgaggcggaagccggagcatttgggggacgggaccgcgggaacccggaaacgcctgggctgcaccgagctggcggtggctacggcgacgggagccggcggcgctgcgggtcagcggtcgcgtaggacccagcggactcggcagcctggggcgcccggcggagctgaaccgcggcccccggtggtgggctcagccggtcgagctgcgcgggaggcaaatgaagataaaacaatgttcgccaacctaaaatacgtttccctgggaattttggtctttcagactaccagtttggttctaacaatgcgttattccagaacttttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacatttatgatggagaactggtatcaaagaatggattttttcagggatataaccgactgacctggatagtagttgttcttcaggcacttggaggccttgtaatagctgctgttattaagtatgcagataatattttaaaaggatttgcaacctctttatcgataatattatcaacattgatctcctatttttggcttcaagattttgtgccaaccagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactcattg

SEQ ID NO: 279913 - DNA, 749 bp, Homo sapiens
ttcaactaaagaattaaggccttttgttattgaatgtattgtatacaaaatccctattaaggtgaaatacagaacttaaaatagctttgctttggaagacagtatagtgcagtcgatgagagtgcaggctgtagagttagacatacctgggtttgatcctcttgaagttgtgggactttagacaagttatttaaattctttaaaactgtttcctcatgtgtaaaaaatgaatactaatacatcttcatagatttgctgtgacaactcaatgaaataatgcatataaagcacttagccagatacctggaatgtagtaagtactcaagatttgttagccgtgttactggaacatttttccccacattataattgtttttatagtaaagaaatagaaggaacttgttctgcttttaatctgattttctcttttttattttgtcttcatcttattcagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccag

SEQ ID NO: 279914 - DNA, 406 bp, Homo sapiens
tggtggcaggtggaggagagacctgcaggccctctcccttctccctctcggtgtttttaaatatactagttttcatatgttgtaatcttatttatttgccctgtttattttgtttttcaggcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcagtaggtatctaggttttttgtttttaatcaatgcaatttatttagtttgcatatatatattggtaactacacatttgcact

SEQ ID NO: 279915 - DNA, 2666 bp, Homo sapiens
gagaggtgtagcagaaagcagtgccccaggcctccacgcgacggtgaagcaggaaccaggggctgccagcagagcagcccaggtgcgtcgccttagggacagagctgccaagtgccgagctggggctgccagagccgagccgggaacggcatttgccagagccgaggcggaagccggagcatttgggggacgggaccgcgggaacccggaaacgcctgggctgcaccgagctggcggtggctacggcgacgggagccggcggcgctgcgggtcagcggtcgcgtaggacccagcggactcggcagcctggggcgcccggcggagctgaaccgcggcccccggtggtgggctcagccggtcgagctgcgcgggaggcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttgtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactcattgatctgtaaaaacttctttaatctacaactgtttacaaaaacaacattcaaacaaatagtacagatgtcagtgacagaacaaaatgacttttcttggagacattccagattgccatattactttattttaaacagcgctatgactttaaatccaaggctgctcggaagatttttttaggtctctcataagcctattcttccctgatcacatgagtgggagaggtagccaaattttgaattccctttctgtgttcccacaagagctgctgagaaggcctggcgcagtggctcacgcctgtaatcctagcagtttgggaggctgaggcaggtggatcacaaggtcaagagattgagactatcctgaccaacatggtgaaaccccgtctctaccaaaaatacaaaaattagctgggtgtggtggcacgcacctgtagtcccagctactcgggagactgaggcaggagaatcacttgaacccgggaggcagaggttgcagtaagtggagatcacgccactgcactccaacctgggcgacacagtgagagtctgtctcaaaaaaaagaaaaaaaaaa

SEQ ID NO: 279916 - DNA, 2447 bp, Homo sapiens
gagaggtgtagcagaaagcagtgccccaggcctccacgcgacggtgaagcaggaaccaggggctgccagcagagcagcccaggtgcgtcgccttagggacagagctgccaagtgccgagctggggctgccagagccgagccgggaacggcatttgccagagccgaggcggaagccggagcatttgggggacgggaccgcgggaacccggaaacgcctgggctgcaccgagctggcggtggctacggcgacgggagccggcggcgctgcgggtcagcggtcgcgtaggacccagcggactcggcagcctggggcgcccggcggagctgaaccgcggcccccggtggtgggctcagccggtcgagctgcgcgggagggtctcactgtcaccttggctggagtacagaggcgcaatctcagctcactgcaacttccacctccctggctcaagtgatctcccaccttagcctcccaagcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacatttatgatggagaactggtatcaaagaatggattttttcagggatataaccgactgacctggatagtagttgttcttcaggcacttggaggccttgtaatagctgctgttattaagtatgcagataatattttaaaaggatttgcaacctctttatcgataatattatcaacattgatctcctatttttggcttcaagattttgtgccaaccagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactcattg

SEQ ID NO: 279917 - DNA, 2214 bp, Homo sapiens
gagaggtgtagcagaaagcagtgccccaggcctccacgcgacggtgaagcaggaaccaggggctgccagcagagcagcccaggtgcgtcgccttagggacagagctgccaagtgccgagctggggctgccagagccgagccgggaacggcatttgccagagccgaggcggaagccggagcatttgggggacgggaccgcgggaacccggaaacgcctgggctgcaccgagctggcggtggctacggcgacgggagccggcggcgctgcgggtcagcggtcgcgtaggacccagcggactcggcagcctggggcgcccggcggagctgaaccgcggcccccggtggtgggctcagccggtcgagctgcgcgggaggcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacatttatgatggagaactggtatcaaagaatggattttttcagggatataaccgactgacctggatagtagttgttcttcagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactcattg

SEQ ID NO: 279918 - DNA, 878 bp, Homo sapiens
ctcagaggtcgcagaccagacctctccgggcacgtccctccccgacgcgtcgccgggctgcgctggagccgctcaccgtccgggtccttctcgtggtagcagtggtagttgcactccacctccatgttctccaaaaaggacttgacctgctcctcatcctggaagtccaccatgccggccatggttcgcgccggcccaaagacggtcacgctagagtgcagtggcgtgattttggctcaccgcaacctccgccttacggtttcaagcaattctcctgcctcagcctcctgaatagctgggattacaggcgcccaccacaatgcccgcctaatttttgtatttttagtagagatggggtttcaccatatcggccaggctggtctcgaactcctgacctcgtgatccgtttgaactaactgttgcctctgccctagagtgcttttcccctgtatttttttttttttttttggcttgccttcttaagttctctgcttcaatttgacatcgtccatgtggtcttagctcattcttgttataataacagtgtcttgattgtgcccagcaatattaggtgcccaagtattgttgactgaattaagaagagggattatcattccaaataatttggttttcattaatggaacttagaatatcactgactcttgctcttttgacccaggtttttcttaaagctataagaaacattaaatgaaggtctaattgacatacaggaaactgcacataactttaaagtaacaattatgagtttctacatatgtatacacctgtaaaccattatcacaatcaagataatgagcatattcatcacctcaaaatttcctcatgtgactttgtacttcattccctccccagcaacc

SEQ ID NO: 279919 - DNA, 699 bp, Homo sapiens
cagcgcctgaaacaccttgtagtggtttcactaacataagttaaaacataagcacttaggaagaaagtcttccctcattaatttctggcatagtgcagctacatgttcattctggaacttaaagtaccttcctcttagaaaatcaaagtgttttcacagcaagtttaataaattaaaaatgtagagaaaaaaggaactagtgaacaaaagaattctccaaggttccctttttaaattaatgtttaaatgttacatgtgaatcatagcatttcacaagcacgtggcacatactcaaggccctagaaccaaatgtcaacgtttaacaaatacagcagaatcgtcttttcattgtgaatttttaaaagcaataattaagtcctgcatgaaacagccaaagaagcatttgggacaaagttactggttcttcacaatcaactctttaaggcataatcggaggtaagtgtgctgagacttttggtccctactgctatgttctcacatgctcccaaggaaatagacatgtcagttacttgcctgtttccatctctaggtgtggaaatgagaagtctgggtttctggaaattacagaaatcaagtcagaaaaacctggcaaaagtaataatactctgtgttctataatttgccacagtcacctcattttgcaaataaaatgactacacaactttcaagtactctaaa

SEQ ID NO: 279920 - DNA, 379 bp, Homo sapiens
ccttgatttcaggtcctaaagtatattcacaacacttcagcatttcacaagcacgtggcacatactcaaggccctagaaccaaatgtcaacgtttaacaaatacagcagaatcgtcttttcattgtgaatttttaaaagcaataattaagtcctgcatgaaacagccaaagaagcatttgggacaaagttactggttcttcacaatcaactctttaaggcataatcggaggtgtggaaatgagaagtctgggtttctggaaattacagaaatcaagtcagaaaaacctggcaaaagtaataatactctgtgttctataatttgccacagtcacctcattttgcaaataaaatgactacacaactttcaagtactctaaa

SEQ ID NO: 279921 - DNA, 1899 bp, Homo sapiens
  misc_feature (5)..(5): n is a, c, g, or t
aggcncgggctttctcctgcagcgataagggcagtcgacagtctttagtagggaaaggagacaagtgctagctactgccgcccaagtggaaggaattatctatagagtaagtatgctaatcttgactaagactgcaggagttttttttaaaccatcaaaaaggaaagtttatgaatttttaagaagttttaattttcatcctggaacactatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagactttctttaataaaacatccagagtgctccaccatgagtggtgggaaagccatagaacatttggccaaacaaggaaatagatttcattttgacatcaaacctcccttgcatcatgctaaaaattgtgatttttcttttactggacttcaacacgttactgataaaataataatgaaaaaggaaaaagaggaaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactggttgcatctggtggtgtcgcaagtaacttctatatccgcagagctctggaaattttaacaaacgcaacacagtgcactttgttgtgtcctcctcccagactatgcactgataatggcattatgattgcatggaatggtattgaaagactacgtgctggcttgggcattttacatgacatagaaggcatccgctatgaaccaaaatgtcctcttggagtagacatatcaaaagaagttggagaagcttccataaaagtaccacaattaaaaatggagatatgatttctgctgttcaaaaaagtccctaaagagacaggctcttgccatgttgcccgggctggtcctgaactgctgaattcaagtgatcctcccaccttggcctccagaagtgctgggattatgggtgtgagccaccatgcctagccaaaatgtttcttaaggtatacattttgggtcttagaagacttatacatttgtaatatttattactaaatatctcaaagtattacaataaatgttaccatgtgagctactttgaatcaggcttcttgcacaccaatttaaaaatgttaactcttgatatatacactagttataccactcatgtcagtcaataaattttaaggtttaagtgcaggcctttgtttacagaaatcctaattttttgaaaccataactctgacctgacactaaattcctgtagacatgctaaggaaaatctgcttagtatcgagatcaagaacttccattcaaaaagattattcagttatgttatttgcatattaccattgttaaaaataaaaaaatttttaaaagaaaaaaaa

SEQ ID NO: 279922 - DNA, 1913 bp, Homo sapiens
cgttctttggtaaccctgctagggggcgccgctagattccatcctatttctccgatgaaagtatcaggaattatctatagagtaagtatgctaatcttgactaagactgcaggagttttttttaaaccatcaaaaaggaaagtttatgaatttttaagaagttttaattttcatcctggaacactatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagactttctttaataaaacatccagagtgctccaccatgagtggtgggaaagccatagaacatttggccaaacaaggaaatagatttcattttgacatcaaacctcccttgcatcatgctaaaaattgtgatttttcttttactggacttcaacacgttactgataaaataataatgaaaaaggaaaaagaggaaggtatatttctaattagtaaagttgaacagataaatattcctggattgtgcctaaaaatagctgctcatttctgcaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactggttgcatctggtggtgtcgcaagtaacttctatatccgcagagctctggaaattttaacaaacgcaacacagtgcactttgttgtgtcctcctcccagactatgcactgataatggcattatgattgcatggaatggtattgaaagactacgtgctggcttgggcattttacatgacatagaaggcatccgctatgaaccaaaatgtcctcttggagtagacatatcaaaagaagttggagaagcttccataaaagtaccacaattaaaaatggagatatgatttctgctgttcaaaaaagtccctaaaggtagtattaaggttaaaattaagtttttattgttttgtgtatcaaattgtagaagatatataatattaattattcatcaagattttatttttttttttctatttgatgttttacctgctcttctgagatactataatgtgttaaaagtcttacaagggaagatagtttttttcttttaattattaaaaaccaaaataaaacatcttttgagaaaggaatgtattgatgctggcaggtagaaaggaagctttgaaagaagcacagtaattttgctgaattctggccctgtatcatacaggcctaggactttcccccacttcctcaaatcaggataggagaagctattttttaactcctactgaaacaagaacctgactttataatgagagagcagtttaatttttttttatcattattattttttggagataatctcccttgcactccagcccgggtgacagagtgagactccgtctc

SEQ ID NO: 279923 - DNA, 1945 bp, Homo sapiens
  misc_feature (5)..(5): n is a, c, g, or t
aggcncgggctttctcctgcagcgataagggcagtcgacagtctttagtagggaaaggagacaagtgctagctactgccgcccaagtggaagtatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagactttctttaataaaacatccagagtgctccaccatgagtggtgggaaagccatagaacatttggccaaacaaggaaatagatttcattttgacatcaaacctcccttgcatcatgctaaaaattgtgatttttcttttactggacttcaacacgttactgataaaataataatgaaaaaggaaaaagaggaaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactggttgcatctggtggtgtcgcaagtaacttctatatccgcagagctctggaaattttaacaaacgcaacacagtgcactttgttgtgtcctcctcccagactatgcactgataatggcattatgattgcatggaatggtattgaaagactacgtgctggcttgggcattttacatgacatagaaggcatccgctatgaaccaaaatgtcctcttggagtagacatatcaaaagaagttggagaagcttccataaaagtaccacaattaaaaatggagatatgatttctgctgttcaaaaaagtccctaaagggtctcactctctgacctcagctggagtacagtagccagatcacaactcactgcaaccctgacttcctgaactcaagaaatcctcctgccttagcctcttgaatagccgggactacaggtgtgcatgtccatgcccagccaactttatttctattttttgtagagacaggctcttgccatgttgcccgggctggtcctgaactgctgaattcaagtgatcctcccaccttggcctccagaagtgctgggattatgggtgtgagccaccatgcctagccaaaatgtttcttaaggtatacattttgggtcttagaagacttatacatttgtaatatttattactaaatatctcaaagtattacaataaatgttaccatgtgagctactttgaatcaggcttcttgcacaccaatttaaaaatgttaactcttgatatatacactagttataccactcatgtcagtcaataaattttaaggtttaagtgcaggcctttgtttacagaaatcctaattttttgaaaccataactctgacctgacactaaattcctgtagacatgctaaggaaaatctgcttagtatcgagatcaagaacttccattcaaaaagattattcagttatgttatttgcatattaccattgttaaaaataaaaaaatttttaaaagaaaaaaaa

SEQ ID NO: 279924 - DNA, 2704 bp, Homo sapiens
  misc_feature (873)..(873): n is a, c, g, or t
tttagctgtaatatcatttttcttcatttttacaatcttaaaactacaaaatgctgtctttctttctttcagaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtaattaagaattaatttctccattcttttttgttatgttgtccatttcaactaagtagcaatagatgtgctaccaccattcacctaaatatttctgaattttatcttagtaaactgaaaaaaattcacatatggtgagaaaaaatagaaagagtagtacacaattttataattcttagcctttcttaataaaatggtaagaggttcatatctgtacataaaggctgaaatagtttgcagatacagttatgtattttgccaaataatgtatgtgaaagaacgtgcttcgtaaactaacatactgcaaaaaaggtaaaataagagaatatatatagattaacataaggacattaaagatgcaatgcacagaattaaatcacacaattacttacaccacagacagggtccccccncacccccctttgttttagaatactacagaggctactgccatatataggaaaacaaacaaacaaacaaacaaaacactgcttcccacagtgaaataataggaagtataggacaagttcttattattgacgttcatcattaagcagttattgtcaacttcaagcccattttccaaccaatagaagagcaaacatagacaggggcagtgattggcctcttattgttcgggtcatcataaggaacagggttgtctgcttacctgaatatcagctatagtctatatttgccaaagtatagcatgttttattcattcaggggttttttgttttgttagtaattttcaatttatttcctttgcatcttttcgtttcacagtatttaattttatgactctaaaaaatatgtttctttgataggtggcaagaagactttctttaataaaacatccagagtgctccaccatgagtggtgggaaagccatagaacatttggccaaacaaggaaatagatttcattttgacatcaaacctcccttgcatcatgctaaaaattgtgatttttcttttactggacttcaacacgttactgataaaataataatgaaaaaggaaaaagaggaaggtatatttctaattagtaaagttgaacagataaatattcctggattgtgcctaaaaatagctgctcatttctgcaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactggttgcatctggtggtgtcgcaagtaacttctatatccgcagagctctggaaattttaacaaacgcaacacagtgcactttgttgtgtcctcctcccagactatgcactgataatggcattatgattgcatggaatggtattgaaagactacgtgctggcttgggcattttacatgacatagaaggcatccgctatgaaccaaaatgtcctcttggagtagacatatcaaaagaagttggagaagcttccataaaagtaccacaattaaaaatggagatatgatttctgctgttcaaaaaagtccctaaagggtctcactctctgacctcagctggagtacagtagccagatcacaactcactgcaaccctgacttcctgaactcaagaaatcctcctgccttagcctcttgaatagccgggactacaggtgtgcatgtccatgcccagccaactttatttctattttttgtagagacaggctcttgccatgttgcccgggctggtcctgaactgctgaattcaagtgatcctcccaccttggcctccagaagtgctgggattatgggtgtgagccaccatgcctagccaaaatgtttcttaaggtatacattttgggtcttagaagacttatacatttgtaatatttattactaaatatctcaaagtattacaataaatgttaccatgtgagctactttgaatcaggcttcttgcacaccaatttaaaaatgttaactcttgatatatacactagttataccactcatgtcagtcaataaattttaaggtttaagtgcaggcctttgtttacagaaatcctaattttttgaaaccataactctgacctgacactaaattcctgtagacatgctaaggaaaatctgcttagtatcgagatcaagaacttccattcaaaaagattattcagttatgttatttgcatattaccattgttaaaaataaaaaaatttttaaaagaaaaaaaa

SEQ ID NO: 279925 - DNA, 2215 bp, Homo sapiens
  misc_feature (5)..(5): n is a, c, g, or t
aggcncgggctttctcctgcagcgataagggcagtcgacagtctttagtagggaaaggagacaagtgctagctactgccgcccaagtggaaggtgggtgaaattgctcactcttcaccccactgacgcttttgcgcacctggaaaagcggttccagtttgcgcccgtcgccgccttacagccgacaggagaccagcgctacccaagtcacgtgggttcagcctgcagctttcttggcccgaaagggaattatctatagagtaagtatgctaatcttgactaagactgcaggagttttttttaaaccatcaaaaaggaaagtttatgaatttttaagaagttttaattttcatcctggaacactatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagactttctttaataaaacatccagagtgctccaccatgagtggtgggaaagccatagaacatttggccaaacaaggaaatagatttcattttgacatcaaacctcccttgcatcatgctaaaaattgtgatttttcttttactggacttcaacacgttactgataaaataataatgaaaaaggaaaaagaggaaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactggttgcatctggtggtgtcgcaagtaacttctatatccgcagagctctggaaattttaacaaacgcaacacagtgcactttgttgtgtcctcctcccagactatgcactgataatggcattatgattgcatggaatggtattgaaagactacgtgctggcttgggcattttacatgacatagaaggcatccgctatgaaccaaaatgtcctcttggagtagacatatcaaaagaagttggagaagcttccataaaagtaccacaattaaaaatggagatatgatttctgctgttcaaaaaagtccctaaagggtctcactctctgacctcagctggagtacagtagccagatcacaactcactgcaaccctgacttcctgaactcaagaaatcctcctgccttagcctcttgaatagccgggactacaggtgtgcatgtccatgcccagccaactttatttctattttttgtagagacaggctcttgccatgttgcccgggctggtcctgaactgctgaattcaagtgatcctcccaccttggcctccagaagtgctgggattatgggtgtgagccaccatgcctagccaaaatgtttcttaaggtatacattttgggtcttagaagacttatacatttgtaatatttattactaaatatctcaaagtattacaataaatgttaccatgtgagctactttgaatcaggcttcttgcacaccaatttaaaaatgttaactcttgatatatacactagttataccactcatgtcagtcaataaattttaaggtttaagtgcaggcctttgtttacagaaatcctaattttttgaaaccataactctgacctgacactaaattcctgtagacatgctaaggaaaatctgcttagtatcgagatcaagaacttccattcaaaaagattattcagttatgttatttgcatattaccattgttaaaaataaaaaaatttttaaaagaaaaaaaa

SEQ ID NO: 279926 - DNA, 302 bp, Homo sapiens
ccatctgtggaacacctactacacgccactgtgatgaacttcgtgttcttccacttcatcctcatgacagccctatcaggtccggatactgccccgaaggaactctgctgttggaatagtcgcgttgttcatcatcatcaggacttccataaagaggctgctgagggccatgtggcgggtctggctgtccatgtctgaaaggaatatagacacactcaagaatggctgccagaaagggtgctgaggaattgaaccatctgatgagtaaaagcttggcattttggaactgcatcctgaccaaa

SEQ ID NO: 279927 - DNA, 710 bp, Homo sapiens
  misc_feature (7)..(7): n is a, c, g, or t
  misc_feature (9)..(10): n is a, c, g, or t
ccacgcntnngcttgaagcagcagaggcgggagccccaggttctggccctgtggacctgtttcgggagctgctggaggaagggaaaggagtgatcagaggcaataaagagtacgaggaagaaaagcgacaggagaaagagaggcaagagaaagctctgggcatcctgacatacctgggccagagtgcagcggaggcacagactcaacccccttggtaccagctacccccagggcgagggggccccccgcccggcccagccccagatgagaagatcaagagccgtctggaccctctgcgggagatgcagaagcatctggggaagaagagacagcacggcggtgatgaaggcagtcgcagcagaaaggaaaaggaggggtctgagaagcagcgacccaaggagcctccatccctggaccagcttcgagctgaacgtctgcggagggaagcagctgagaggtctcgggcagaggccctgctggcccgggtccaaggccgggcactacaggagggtcagccggaagaagacgagacggatgaccggcggcggcggtacaactcccaattcaacccccagctggcccggcgcccccgccagcaggaccctcaccttactcactgactcctgagggggtacaggagaggccgctgctgccagccgtcatataaaactatttattcataaatattttccaaaatgaaaaaaaaatac

SEQ ID NO: 279928 - DNA, 563 bp, Homo sapiens
gcttgtattataataaggtaacacattcgcgtacatgttgggcctcacccattcacacctgtcatttatttacattttgccagtttcactaaaatactataaaactaaaaataattaaactctgctaatgatacaacaccagacagatcgtgaaaacacttgcaacctggcctaagactagtaagaattgagtattgaagatgacatgtggaattggaagggaaaagatgattctgcaaatggtttgtacaacgagcatgaatgtcaaatggattaaagattgacatggagaaagtgaaactgtaaaagtattagaagaaaatataggtagaggcttatatgataggttacggaaagactttcccagcatggcacagtaagcagaaatcctgggtaaaagttgaataaactcaaatgtgtaaaattaaagttctaaaatgcacaaatgtataaaaaataaagatctaaaaatgctcaacagaaactgaaattgaaagcaaatcatagagatgagaggttaatatactcttgctgtataaaataagaatcattgaaaataaacc

SEQ ID NO: 279929 - DNA, 459 bp, Homo sapiens
agacctcatagcctgcgggagatgggagtccgggacgcggacaggacgggcacttacctacgaatagccagagggagccccccgacacgaggaagaagcatgcagagcccaccaggactccagcaccgaggacagcgctcaggcagccgggccttctctatacgcagccctcccaggccaggagctggctgagccacagcccagaaagaagaggatagaaaaccagagagcagaagtcaggaagcagagagtggaagagcatgagatctcttcaggcccaccagagaccatcagccatgagtgcatgtgggctcacagctcagcagctgggatctggactcctgggagagctgctccagcttgaactcagccacagcctggcagggactttgctgggatctcaagcttggcagggctcctccaagagggtgtgacagaggctgtatggcaggactcctc

SEQ ID NO: 279930 - DNA, 459 bp, Homo sapiens
ttctgcttcattccatggccagagcaagccacgtgggcaagcccgaaaccagggggcgggaaagtaccctccacccacaaggaaaccatggcaagcggtggttgcagacgcaaaaaccaaggccaaacagctgagttttctgccctggaggaggaaagtggtctctgaaagccagaagactctcacattacataattcctgccagctgctgtcaagagctgctaagctgtcctcaagtcctgtgtctgatgtcaagctaataacagatttcgggtgcattagtaaaggtatcttaatcaagtctagatgccttcgagattagactcagccatgatgagcagctaaggattagcaagaaagattacaaattgtttccaggaatttatttctttcaacactgattatatgtatagtcttaagtcaaattaaaatgttgtttatgttcagctgtttttgtga

SEQ ID NO: 279931 - DNA, 432 bp, Homo sapiens
aatatatgcgacatgtacagtggtttgatctggaaaggctggacaactggaatggggttggggaagtggacgacttccagacgcaaaaaccaaggccaaacagctgagttttctgccctggaggaggaaagtggtctctgaaagccagaagactctcacattacataattcctgccagctgctgtcaagagctgctaagctgtcctcaagtcctgtgtctgatgtcaagctaataacagatttcgggtgcattagtaaaggtatcttaatcaagtctagatgccttcgagattagactcagccatgatgagcagctaaggattagcaagaaagattacaaattgtttccaggaatttatttctttcaacactgattatatgtatagtcttaagtcaaattaaaatgttgtttatgttcagctgtttttgtga

SEQ ID NO: 279932 - DNA, 709 bp, Homo sapiens
catcatttctgagtgtgtctgtgtggtgttccagaagagattagcatcagaagactaaagaagatctgccctcaccaatgcaggcaggcatagcaagtttgccaacctgtatcttaattcatctttgtggccagagaagtggatttactgatttgtttcagctgatcaatgtctataacaagcaatgttgatgggctgaaaaccacacagactaccagaggggttgcttttccgaagaatcatgtaaggataaaagagaaagaaagagagaaagaccttggaacccaactagtatctaccaaatagacaggatctcactgtgttgcccaggctggtcgccaactcctggcctcaagtgttcctctggccctggcctcccaaagcactgggattacagttctcttcagggaattttgtctggttcaagaagtcataccccaacccaagagaagccttggacatctctcataagacatccaagggacagagctcctgggagacctagagtgagctggagagtgaacaacataccccactgggaagtaagcagccctggattctgcctcttgctaactgattcgtttcgaaccctgtttttctatctgtaaaagggactgtaactcccctgcccctgcctagattctcatacctggagactagggggctaagaccccttctagagataaaaataaaagtcttaaagagaaag

SEQ ID NO: 279933 - DNA, 3717 bp, Homo sapiens
tttgtttaacatgcaagaatggtgttcagtctgaaggtgattctcttcctatccttgcttctctcgcctgtattgaaaagctcactggtaactttgaataacaatggatatgatggcattgtgattgcaattaatcccagtgtaccagaagatgaaaaactcattcaaaacataaaggaaatggtaactgaagcatctactcacctgtttcatgccaccaaacaaagagcttatttcaggaatgtaagcattttaattccaatgacctacaaatcaaaatctgagtacttaatcccaaaacaagaaacatatgaccaggcagatgtcatagttgctgatctttacctgaaatacggagatgatccctatacacttcaatatggacaatgtggagataaaggacaatatatacattttactccaaacttcttgttgactaataacttggctacctatgggcctcgaggtaaagtatttgtccatgggtgggcccatctccggtggggagtatttgatgagtataatgtggaccagccattctatatttccagaagaaacactactgaagcaacaagatgttccactcgtattactgtttacatggttttgaacgaatgcaagggggccagctgtatagcacgaccattcagacgtgactcacagacagggctgtatgaagcaaaatgtacatttatcccaaagagatcccagactgccaaggaatccattgtgtttatgcaaaatcttgattctgtgactgaattttgtactgaaaaaacacacaataaagaagctccaaacctatagaacaaaatgtgcaatcacagaagcacatgggatgtaatcatgagctctgaagattttcagcatttatctcccatgacagaaataaatttacctcgtcctacattttcattgctcaagtccaaacagcgtgtagtctgtttggtacttgataaatctggaagcatgaatgcagaagaccgtctctttcgaatgaatcaagcagcagaattgtacttgattcaaattattgaaaagggatccttggttgggttggtcacatttgacagttttgctaaaatccaaagtaagctcataaaaataattgatgataacacttaccaaaagatcactgcaaacctgcctcaagaagctgatggtggcacttcaatttgcaggggactcaaagcaggatttcaggcaattccccagagtaatcagagtactttcggttctgaaatcatattactaacagatggggaagattatcaaataagcttatgctttggagaggtaaaacaaagtggcacagtcatccacaccattgctctggggccgtctgctgacgaagaactggagaccctgtcaaatatgacaggattacataagggacactgatatactgaaagttcataaagtgctgggaagttcatcttttgaggacatcgtttttatgcccataaaaacataaatggccttattgatgctttcagcagaatttcatctagaagtggcagcatctctcagcaggctcttcagttggaaagtaaaactttgaatatcccagcgaagaaatggataaatggtacagtgcctgtggatagtacagttagaaatgatacttcctttgttgtcacatggacgatacaaaagccagcaataattcttcaagatccaaaaggaaaaaaatatactacctcagattttcaagaaggtgaactaaatattcggtctgcccgtcttcgaataccaggtattgcagaggtaggtctattattttatgttctctaagttttcttaatcaatttctatttttaaaagataaaaataacatagataacatcttatacattgccaatattaaaatgatgacagatcatctgtaataaagaaatcaaatggaataattagggattcatattcatactatttactagtttgtgaaattcaatattaaaaatcatgattattattctgcttaaatttgtaaataattttgtattccaaacaaaaagtaggaaaatattaccaaagctctcagacagatttttttttaatgtttcagacaggcacttggacttacagcgttcgaaacaatcataccaaatctcaattgctaactgtgacaatgaccactcgagcaagaagccctaccacactcccagtaattgcaactgctcacatgagtcaaaatacagctcattaccctagcccagtgattgtttatgcatgagtcagtcaagggtttcttcctgttctgggaatcaatgtaacagccattatagaaaatgaagagggacatcaagtaacattggagctctgggacaatggcgcaggtgctgattctgtcaagaatgatggcatctactcaaggtattttacagattaccatggaaatggtagatacagtttaaaagtgcttacccaggcaagaaaaaacacagctaggctaagtcaacaacagaataaagctctgtatgtaccgcgctatgctgaaaatggaaaaattatactgaacccatccaaacctgaagtcacagatgatgtggaaggagctcaaacagacgacttcagcagactcacctctggagggtcgtttactgtatcaggagtgcctcctaatggtaatcattctcaggtgttctcacctggtaaaattgtagacctcgaggctaagtttcaaggagatcatattcaactttcatggactgcccctggcaaggtcctcgataaaggaagagctgagagctacattataagaataagtaaacatttcctggacctccaagaagattttgataaagctgctttaataaatacttctggtctgatacctaaggagcctggttcagtagaaagttttgaatttaaaccagaaccttctaaaatagagaatggtacgacattctatattgcaattcaagccatccatgaagccaatgtcacctcagaggtttcaaacattgcacaagcaactaactttattcctccacaggaacccagcattcctgatctgggtaccaatatttctgcaatcagtttggcaatttttggattagctgtaattttatctatattttaaactagaaattatattagaactcaaattcaatgttatacatacttggtaaacatttatttaaaatttaatttactatacttattgtctattataaagctcattataatataaaaagtgaagtacaaaagttgtaagtttcctaattacttgattaattaatactatttgagttattaaatgttaatcaaaatgagtatatcatttcctgtcttggaataatccactcattaatttttaatatgaaaagatatatatttgtacttgtaagcattttaagaaacatttttaaagtgtgctacaaattcatttggtgtactaacatcaaaatgtatccaagccatttaaaaaatatttatatatacatagtagcaaatagttttatagatttatttgtatcgcattttttattacaaatgaatatttcatgtttatataagctgtaatcaaaaaggactagtagtagtagtaaggaagtcaaatttgtttttttatcattgattataagtggtatatttgttttttgtcattgattaaaagtgattttagccctaggcccgaaatgactagcaaatatcattttctgtatgaattgtggaacatcacaataaaattatttctgtgctgatgctaaa

SEQ ID NO: 279934 - DNA, 490 bp, Homo sapiens
caactcatagacatagcacttatgccatttttaaattttatgaacaattttgctttttccatggaacttaagagcacaatttttctctattttcattaatgtcagtgtttcatatatgctttcttcagttgctttttcttattttgataagtattttttatgaaataatagtaacagctaatattaattgaatcccttccatgaattagacttttccaaaaacacagagttagcaagtggcccaagctttcaaccaaaatagtctgattccagaattcatgtacttaaaacgctgtgctacatactatctcccaaattactaacattatcagtgttcataaacagatatgactgtcatttttactttattgtatgactaatttttacatttcattatcaaggtgctgattctgtcaagaatgatggcatctactcaaggtattttacagattaccatggaaatggtagatacagtttaaaagtgcttacc

SEQ ID NO: 279935 - DNA, 3416 bp, Homo sapiens
tttgtttaacatgcaagaatggtgttcagtctgaaggtgattctcttcctatccttgcttctctcgcctgtattgaaaagctcactggtaactttgaataacaatggatatgatggcattgtgattgcaattaatcccagtgtaccagaagatgaaaaactcattcaaaacataaaggaaatggtaactgaagcatctactcacctgtttcatgccaccaaacaaagagcttatttcaggaatgtaagcattttaattccaatgacctacaaatcaaaatctgagtacttaatcccaaaacaagaaacatatgaccaggcagatgtcatagttgctgatctttacctgaaatacggagatgatccctatacacttcaatatggacaatgtggagataaaggacaatatatacattttactccaaacttcttgttgactaataacttggctacctatgggcctcgaggtaaagtatttgtccatgggtgggcccatctccggtggggagtatttgatgagtataatgtggaccagccattctatatttccagaagaaacactactgaagcaacaagatgttccactcgtattactgtttacatggttttgaacgaatgcaagggggccagctgtatagcacgaccattcagacgtgactcacagacagggctgtatgaagcaaaatgtacatttatcccaaagagatcccagactgccaaggaatccattgtgtttatgcaaaatcttgattctgtgactgaattttgtactgaaaaaacacacaataaagaagctccaaacctatagaacaaaatgtgcaatcacagaagcacatgggatgtaatcatgagctctgaagattttcagcatttatctcccatgacagaaataaatttacctcgtcctacattttcattgctcaagtccaaacagcgtgtagtctgtttggtacttgataaatctggaagcatgaatgcagaagaccgtctctttcgaatgaatcaagcagcagaattgtacttgattcaaattattgaaaagggatccttggttgggttggtcacatttgacagttttgctaaaatccaaagtaagctcataaaaataattgatgataacacttaccaaaagatcactgcaaacctgcctcaagaagctgatggtggcacttcaatttgcaggggactcaaagcaggatttcaggcaattccccagagtaatcagagtactttcggttctgaaatcatattactaacagatggggaagattatcaaataagcttatgctttggagaggtaaaacaaagtggcacagtcatccacaccattgctctggggccgtctgctgacgaagaactggagaccctgtcaaatatgacaggattacataagggacactgatatactgaaagttcataaagtgctgggaagttcatcttttgaggacatcgtttttatgcccataaaaacataaatggccttattgatgctttcagcagaatttcatctagaagtggcagcatctctcagcaggctcttcagttggaaagtaaaactttgaatatcccagcgaagaaatggataaatggtacagtgcctgtggatagtacagttagaaatgatacttcctttgttgtcacatggacgatacaaaagccagcaataattcttcaagatccaaaaggaaaaaaatatactacctcagattttcaagaaggtgaactaaatattcggtctgcccgtcttcgaataccaggtattgcagagacaggcacttggacttacagcgttcgaaacaatcataccaaatctcaattgctaactgtgacaatgaccactcgagcaagaagccctaccacactcccagtaattgcaactgctcacatgagtcaaaatacagctcattaccctagcccagtgattgtttatgcatgagtcagtcaagggtttcttcctgttctgggaatcaatgtaacagccattatagaaaatgaagagggacatcaagtaacattggagctctgggacaatggcgcaggtgctgattctgtcaagaatgatggcatctactcaaggtattttacagattaccatggaaatggtagatacagtttaaaagtgcttacccaggcaagaaaaaacacagctaggctaagtcaacaacagaataaagctctgtatgtaccgcgctatgctgaaaatggaaaaattatactgaacccatccaaacctgaagtcacagatgatgtggaaggagctcaaacagacgacttcagcagactcacctctggagggtcgtttactgtatcaggagtgcctcctaatggtaatcattctcaggtgttctcacctggtaaaattgtagacctcgaggctaagtttcaaggagatcatattcaactttcatggactgcccctggcaaggtcctcgataaaggaagagctgagagctacattataagaataagtaaacatttcctggacctccaagaagattttgataaagctgctttaataaatacttctggtctgatacctaaggagcctggttcagtagaaagttttgaatttaaaccagaaccttctaaaatagagaatggtacgacattctatattgcaattcaagccatccatgaagccaatgtcacctcagaggtttcaaacattgcacaagcaactaactttattcctccacaggaacccagcattcctgatctgggtaccaatatttctgcaatcagtttggcaatttttggattagctgtaattttatctatattttaaactagaaattatattagaactcaaattcaatgttatacatacttggtaaacatttatttaaaatttaatttactatacttattgtctattataaagctcattataatataaaaagtgaagtacaaaagttgtaagtttcctaattacttgattaattaatactatttgagttattaaatgttaatcaaaatgagtatatcatttcctgtcttggaataatccactcattaatttttaatatgaaaagatatatatttgtacttgtaagcattttaagaaacatttttaaagtgtgctacaaattcatttggtgtactaacatcaaaatgtatccaagccatttaaaaaatatttatatatacatagtagcaaatagttttatagatttatttgtatcgcattttttattacaaatgaatatttcatgtttatataagctgtaatcaaaaaggactagtagtagtagtaaggaagtcaaatttgtttttttatcattgattataagtggtatatttgttttttgtcattgattaaaagtgattttagccctaggcccgaaatgactagcaaatatcattttctgtatgaattgtggaacatcacaataaaattatttctgtgctgatgctaaa

SEQ ID NO: 279936 - DNA, 1986 bp, Homo sapiens
tttacttcctgcgtccccggacgccgtatgtggaaaggcgaaccctgagtggaggatgttcccgctgcctaaagaatgattgactgtaactgcacttttgtgagattataaatataccacggagggtaacgaagctacagaagaatggaagaagacagcctggaagactcaaaccttcctccaaaagtttggcattctgagatgacggtgtcagtgacaggcgaaccacctagtaccgtagaagaagaaggaatacctaaagaaacagacatagaaatcatcccagaaatcccggaaactctagagccactgtcccttccagatgtgctgaggatctcggcagttctggaggacaccacagaccagctctctattctgaactacatcatgcccgttcagtacgaagggagacagagcatctgcgtgaaaagcagagaaatgaatctagaaggaacgaatctagacaaacttccaatggcctcaacaatcacaaaaatacccagtccgttaataactgaggaaggacccaacttgccagaaatcagacacagaggccggttcgctgtggagtttaacaaaatgcaggatcttgtcttcaaaaaacctacaaggcagaccatcatgactacggagacactgaagaaaattcagattgataggcagtttttcagcgatgtgattgcagataccattaaggagttgcaagattcggccacttacaacagtctcctgcaagctttgagcaaagagagggaaaacaaaatgcatttctatgacatcattgccagggaggaaaaaggaagaaaacagataatatcacttcaaaaacagctaattaatgtcaaaaaggaatggcaatttgaagtccagagtcagaatgagtatattgctaacctcaaggaccaactgcaagagatgaaggcaaaatccaacttggagaatcgctacatgaaaaccaataccgagctgcagattgcccagacccagaaaaagtgtaacagaacagaggaactcttggtggaagagattgagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgccttttaaaaaaat

SEQ ID NO: 279937 - DNA, 2000 bp, Homo sapiens
tggccacatttattgaatatccaatcttgttccaaaaataacttgagactagtcttcaaaaaaagtttttcttgaagtggaaccaagatctctaagacactgtccccccgaccctagaaaccacgacctgatggagatactttataaaaaattacaacatgagaaatgcctgctaacagagatatttcacaaagaactttacttttgagcagagtgtaccaggtggtaagttggggaatgacggagaagaagaatgttgtgtgaagttagcagcagggcgcgtgtggtttggtgtggctgaagaaaggggcacattttcttggagtatagagtagaagtcagagaagatagtgttgaaaaatgtacacaaaggcctctttcttgttgtattgtctctttaaaaaaattctttctaattgtttattgttttaaaagaaaagaaaagcagagaaatgaatctagaaggaacgaatctagacaaacttccaatggcctcaacaatcacaaaaatacccagtccgttaataactgaggaaggacccaacttgccagaaatcagacacagaggccggttcgctgtggagtttaacaaaatgcaggatcttgtcttcaaaaaacctacaaggcagaccatcatgactacggagacactgaagaaaattcagattgataggcagtttttcagcgatgtgattgcagataccattaaggagttgcaagattcggccacttacaacagtctcctgcaagctttgagcaaagagagggaaaacaaaatgcatttctatgacatcattgccagggaggaaaaaggaagaaaacagataatatcacttcaaaaacagctaattaatgtcaaaaaggaatggcaatttgaagtccagagtcagaatgagtatattgctaacctcaaggaccaactgcaagagatgaaggcaaaatccaacttggagaatcgctacatgaaaaccaataccgagctgcagattgcccagacccagaaaaagtgtaacagaacagaggaactcttggtggaagagattgagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgccttttaaaaaaat

SEQ ID NO: 279938 - DNA, 573 bp, Homo sapiens
tactactactaaattcgcggccgcgtcgacggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgccttttaaaaaaat

SEQ ID NO: 279939 - DNA, 1414 bp, Homo sapiens
ctcacaaaaaagaaaagaaaacaagaaagagcagcaggcagatgggaagagggaagcaggaacaaacgtccttgggccgtggaatctgtgtgtgggaggactcctcgctctgagactgacgtggctcaaggccacgtcaacactcttcctggcactccggaatccccctttttaagccccacagccttgtgcccttggagcgccgtttctgtccttcagtgggcacctctgttcagctcacgggattgtgctcgtctcgttagggacacacgcagtccacacagtgccgcgccacgtggctctgcagtgttggtgaacaggagttgcagggaactgaaagcccgggatcccagctggtaaagggagcctcagctaccgaccgagctgctgctctcatcttgagaacttctgattcccagccctgcggggaagacgtactggtatctgattgttcttacagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgccttttaaaaaaat

SEQ ID NO: 279940 - DNA, 916 bp, Homo sapiens
  misc_feature (24)..(24): n is a, c, g, or t
  misc_feature (37)..(37): n is a, c, g, or t
gattgctggaacgactctctaatnaccaccgctacanaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgccttttaaaaaaat

SEQ ID NO: 279941 - DNA, 1361 bp, Homo sapiens
ctcacaaaaaagaaaagaaaacaagaaagagcagcaggcagatgggaagagggaagcaggaacaaacgtccttgggccgtggaatctgtgtgtgggaggactcctcgctctgagactgacgtggctcaaggccacgtcaacactcttcctggcactccggaatccccctttttaagccccacagccttgtgcccttggagcgccgtttctgtccttcagtgggcacctctgttcagctcacgggattgtgctcgtctcgttagggacacacgcagtccacacagtgccgcgccacgtggctctgcagtgttggtgaacaggagttgcagggaactgaaagcccgggatcccagctggtaaagggagcctcagctaccgaccgagctgctgctctcatcttgagaacttctgattcccagccctgcggggaagacgtactggtatctgattgttcttacagaaactcaggatgaaaaccgaagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgccttttaaaaaaat

SEQ ID NO: 279942 - DNA, 932 bp, Homo sapiens
tcttgcttctctcccccgctcgcctccctcaacctccgccagcctcccttctgaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgccttttaaaaaaat

SEQ ID NO: 279943 - DNA, 2148 bp, Homo sapiens
ggaagaaaggctagcgggcgttggccgtatgtgggtgtcttgaggcagtttttcagttctttcatttaccaaagtgacatgcacctactaggtgccaggtgtttagacgtacatacaaccctctgcaaaatctttcagtgtagtcctctgtatgaaaagtttccagccaagaattgccactgcacctgagataagggggatcctggccattaaggaaaccttgccttcgaaactgagccgtgaggaactatacaaaatgggaaattgggacaaatcccagtggctcatgacactaagaagtaaaattacgaactcactgagctggaagtcattcaacgggaattgaataggtaactgcacttttgtgagattataaatataccacggagggtaacgaagctacagaagaatggaagaagacagcctggaagactcaaaccttcctccaaaagtttggcattctgagatgacggtgtcagtgacaggcgaaccacctagtaccgtagaagaagaaggaatacctaaagaaacagacatagaaatcatcccagaaatcccggaaactctagagccactgtcccttccagatgtgctgaggatctcggcagttctggaggacaccacagaccagctctctattctgaactacatcatgcccgttcagtacgaagggagacagagcatctgcgtgaaaagcagagaaatgaatctagaaggaacgaatctagacaaacttccaatggcctcaacaatcacaaaaatacccagtccgttaataactgaggaaggacccaacttgccagaaatcagacacagaggccggttcgctgtggagtttaacaaaatgcaggatcttgtcttcaaaaaacctacaaggcagaccatcatgactacggagacactgaagaaaattcagattgataggcagtttttcagcgatgtgattgcagataccattaaggagttgcaagattcggccacttacaacagtctcctgcaagctttgagcaaagagagggaaaacaaaatgcatttctatgacatcattgccagggaggaaaaaggaagaaaacagataatatcacttcaaaaacagctaattaatgtcaaaaaggaatggcaatttgaagtccagagtcagaatgagtatattgctaacctcaaggaccaactgcaagagatgaaggcaaaatccaacttggagaatcgctacatgaaaaccaataccgagctgcagattgcccagacccagaaaaagtgtaacagaacagaggaactcttggtggaagagattgagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaagcagcgccctaggacctgcgcggccggtgttcacactcagaagcctgtgctttctggggcaccctcacctcccagctggactagagggagtgccgtgtgttctcaagagaatgtacaattacaacccctaaaccacatgagagcctgtgtgtgttttttaacaggtgtttcaactctgagacatcttaaaaatataaccaacccaattccccaaagtctgaaaggcacctactgacacagaaaactgaagttttcatcatcacagtgttgagtgtttcagcattaatagtgaacagtcttttgacctgtgaaaatagctgtcccatttcatatggaagaaaaccaaaccagtgagcccctcaggctgaattctacacccagatgttatgctcctccctcaggctgaattctaaaccggatattatgctcctcacaatctc

SEQ ID NO: 279944 - DNA, 2251 bp, Homo sapiens
ggaagaaaggctagcgggcgttggccgtatgtgggtgtcttgaggcagtttttcagttctttcatttaccaaagtgacatgcacctactaggtgccaggtgtttagacgtacatacaaccctctgcaaaatctttcagtgtagtcctctgtatgaaaagtttccagccaagaattgccactgcacctgagataagggggatcctggccattaaggaaaccttgccttcgaaactgagccgtgaggaactatacaaaatgggaaattgggacaaatcccagtggctcatgacactaagaagtaaaattacgaactcactgagctggaagtcattcaacgggaattgaataggtaactgcacttttgtgagattataaatataccacggagggtaacgaagctacagaagaatggaagaagacagcctggaagactcaaaccttcctccaaaagtttggcattctgagatgacggtgtcagtgacaggcgaaccacctagtaccgtagaagaagaaggaatacctaaagaaacagacatagaaatcatcccagaaatcccggaaactctagagccactgtcccttccagatgtgctgaggatctcggcagttctggaggacaccacagaccagctctctattctgaactacatcatgcccgttcagtacgaagggagacagagcatctgcgtgaaaagcagagaaatgaatctagaaggaacgaatctagacaaacttccaatggcctcaacaatcacaaaaatacccagtccgttaataactgaggaaggacccaacttgccagaaatcagacacagaggccggttcgctgtggagtttaacaaaatgcaggatcttgtcttcaaaaaacctacaaggcagaccatcatgactacggagacactgaagaaaattcagattgataggcagtttttcagcgatgtgattgcagataccattaaggagttgcaagattcggccacttacaacagtctcctgcaagctttgagcaaagagagggaaaacaaaatgcatttctatgacatcattgccagggaggaaaaaggaagaaaacagataatatcacttcaaaaacagctaattaatgtcaaaaaggaatggcaatttgaagtccagagtcagaatgagtatattgctaacctcaaggaccaactgcaagagatgaaggcaaaatccaacttggagaatcgctacatgaaaaccaataccgagctgcagattgcccagacccagaaaaagtgtaacagaacagaggaactcttggtggaagagattgagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgccttttaaaaaaat

SEQ ID NO: 279945 - DNA, 2187 bp, Homo sapiens
agcggagaagttcgccgcagaagatgagggcggcgatcacgtccatcgcgtctcgtggcgcgaagccggccaataaatgctgtttggaggcccactttccagccaagaattgccactgcacctgagataagggggatcctggccattaaggaaaccttgccttcgaaactgagccgtgaggaactatacaaaatgggaaattgggacaaatcccagtggctcatgacactaagaagtaaaattacgaactcactgagctggaagtcattcaacgggaattgaataggtaactgcacttttgtgagattataaatataccacggagggtaacgaagctacagaagaatggaagaagacagcctggaagactcaaaccttcctccaaaagtttggcattctgagatgacggtgtcagtgacaggcgaaccacctagtaccgtagaagaagaaggaatacctaaagaaacagacatagaaatcatcccagaaatcccggaaactctagagccactgtcccttccagatgtgctgaggatctcggcagttctggaggacaccacagaccagctctctattctgaactacatcatgcccgttcagtacgaagggagacagagcatctgcgtgaaaagcagagaaatgaatctagaaggaacgaatctagacaaacttccaatggcctcaacaatcacaaaaatacccagtccgttaataactgaggaaggacccaacttgccagaaatcagacacagaggccggttcgctgtggagtttaacaaaatgcaggatcttgtcttcaaaaaacctacaaggcagaccatcatgactacggagacactgaagaaaattcagattgataggcagtttttcagcgatgtgattgcagataccattaaggagttgcaagattcggccacttacaacagtctcctgcaagctttgagcaaagagagggaaaacaaaatgcatttctatgacatcattgccagggaggaaaaaggaagaaaacagataatatcacttcaaaaacagctaattaatgtcaaaaaggaatggcaatttgaagtccagagtcagaatgagtatattgctaacctcaaggaccaactgcaagagatgaaggcaaaatccaacttggagaatcgctacatgaaaaccaataccgagctgcagattgcccagacccagaaaaagtgtaacagaacagaggaactcttggtggaagagattgagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgccttttaaaaaaat

SEQ ID NO: 279946 - DNA, 2197 bp, Homo sapiens
ggaagaaaggctagcgggcgttggccgtatgtgggtgtcttgaggcagtttttcagttctttcatttaccaaagtgacatgcacctactaggtgccaggtgtttagacgtacatacaaccctctgcaaaatctttcagtgtagtcctctgtatgaaaagtttccagccaagaattgccactgcacctgagataagggggatcctggccattaaggaaaccttgccttcgaaactgagccgtgaggaactatacaaaatgggaaattgggacaaatcccagtggctcatgacactaagaagtaaaattacgaactcactgagctggaagtcattcaacgggaattgaataggtaactgcacttttgtgagattataaatataccacggagggtaacgaagctacagaagaatggaagaagacagcctggaagactcaaaccttcctccaaaagtttggcattctgagatgacggtgtcagtgacaggcgaaccacctagtaccgtagaagaagaaggaatacctaaagaaacagacatagaaatcatcccagaaatcccggaaactctagagccactgtcccttccagatgtgctgaggatctcggcagttctggaggacaccacagaccagctctctattctgaactacatcatgcccgttcagtacgaagggagacagagcatctgcgtgaaaagcagagaaatgaatctagaaggaacgaatctagacaaacttccaatggcctcaacaatcacaaaaatacccagtccgttaataactgaggaaggacccaacttgccagaaatcagacacagaggccggttcgctgtggagtttaacaaaatgcaggatcttgtcttcaaaaaacctacaaggcagaccatcatgactacggagacactgaagaaaattcagattgataggcagtttttcagcgatgtgattgcagataccattaaggagttgcaagattcggccacttacaacagtctcctgcaagctttgagcaaagagagggaaaacaaaatgcatttctatgacatcattgccagggaggaaaaaggaagaaaacagataatatcacttcaaaaacagctaattaatgtcaaaaaggaatggcaatttgaagtccagagtcagaatgagtatattgctaacctcaaggaccaactgcaagagatgaaggcaaaatccaacttggagaatcgctacatgaaaaccaataccgagctgcagattgcccagacccagaaaaagtgtaacagaacagaggaactcttggtggaagagattgagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgccttttaaaaaaat

SEQ ID NO: 279947 - DNA, 935 bp, Homo sapiens
  misc_feature (47)..(47): n is a, c, g, or t
cgggtagggcatcgcgttatgatggtcccccaactcccaaccctgangacttacagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgccttttaaaaaaat

SEQ ID NO: 279948 - DNA, 1466 bp, Homo sapiens
ggaagaaaggctagcgggcgttggccgtatgtgggtgtcttgaggcagtttttcagttctttcatttaccaaagtgacatgcacctactaggtgccaggtgtttagacgtacatacaaccctctgcaaaatctttcagtgtagtcctctgtatgaaaagtttccagccaagaattgccactgcacctgagataagggggatcctggccattaaggaaaccttgccttcgaaactgagccgtgaggaactatacaaaatgggaaattgggacaaatcccagtggctcatgacactaagaagtaaaattacgaactcactgagctggaagtcattcaacgggaattgaataggtaactgcacttttgtgagattataaatataccacggagggtaacgaagctacagaagaatggaagaagacagcctggaagactcaaaccttcctccaaaagtttggcattctgagatgacggtgtcagtgacaggcgaaccacctagtaccgtagaagaagaaggaatacctaaagaaacagacatagaaatcatcccagaaatcccggaaactctagagccactgtcccttccagatgtgctgaggatctcggcagttctggaggacaccacagaccagctctctattctgaactacatcatgcccgttcagtacgaagggagacagagcatctgcgtgaaaagcagagaaatgaatctagaaggaacgaatctagacaaacttccaatggcctcaacaatcacaaaaatacccagtccgttaataactgaggaaggacccaacttgccagaaatcagacacagaggccggttcgctgtggagtttaacaaaatgcaggatcttgtcttcaaaaaacctacaaggcagaccatcatgactacggagacactgaagaaaattcagattgataggcagtttttcagcgatgtgattgcagataccattaaggagttgcaagattcggccacttacaacagtctcctgcaagctttgagcaaagagagggaaaacaaaatgcatttctatgacatcattgccagggaggaaaaaggaagaaaacagataatatcacttcaaaaacagctaattaatgtcaaaaaggaatggcaatttgaagtccagagtcagaatgagtatattgctaacctcaaggaccaactgcaagagatgaaggcaaaatccaacttggagaatcgctacatgaaaaccaataccgagctgcagattgcccagacccagaaaaagtgtaacagaacagaggaactcttggtggaagagattgagtaagaaatacagcatcgagagcgctgaacttcgttcaaacctgagtttataggatgagaagtcacggtgaaaaatgccaggaggaagaaagaagtggtagatcttctttgaggggaatgctaaatggcacacacgcacgcacgcacacacgcacgcacgcacgcacgca

SEQ ID NO: 279949 - DNA, 837 bp, Homo sapiens
aagtttcataattttcatttttctttttcttcttaaaggtgtcaacaaaagtaaacaattttataatcatttaacaaattatataccatactctctccaatagtcagtgtaggatgctattcttttaaattgtaaacttacatttgaaaaaaaggtcggattttttttgtttcctgaaaagatcactggcatcttagaaaaataacatgtagaccagtgctactcaaagtgtgctcaatgactggtgctgtcaaactactgctggtatgtgacaacatagaaattagacatttcaaaatatgtatggcaagttgacattgtcatgacatgatcatcgtgcttatattctgtatgtcttttctttcaaagattatttcatttttctaataatttagtgtatcttacaaaagtattactagtgatgaactagagggaaactggtccatcaccccagacagtctgagaagcactgacaagagccgcagactacagtgtccattgctgcggggcacaaatgactggtatgtgtataacatcagcagatgtagtcacctcttgaatgccttatccatggggtcatttccttcactttcttaaaaagatggtaataaataaaggaagtagaatatgagccctggaagcagacatatgggggcttgaattctgattctaccactttagctatatgtgtccttcagcaactttctcctaccttctctgggtctttcctcatctgtaaaatgaaaataccaaaacatatcacagagtggtcatgaggtgcaaattaagaggtatcgaaggtgcctcatatagtgcctgatggatctctagtcaatg

SEQ ID NO: 279950 - DNA, 3607 bp, Homo sapiens
tggtagttgtcataataggagaatttttcagtgcctcttctgtcacaatcgtagacacggtcacactccagtatctgggaaaacacagagatcgctatgggttgcagcgcatgtggggctccctgggctggggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggacttaatcaagctgctctgcagcgtgcagtatggctcagtgctgtttgtggcttggttcatgggttttggatatggcttcgtgttcacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttcttggagagaaccgtttaaaaaattacaagatatatttaaaaagtaaccagataaaagtagcacatgtgcttttgttaaaaataaagttaaaagttaaagttaaaaaatgaagttaaaagtttcatcagaaactttacatatctttagcaaatatatttttatatgtgtatggcatataatggaaataattctttgagcaacagaagctattattaactactgcaagctaagccgagcttaaaaatgccttttgttttaaatgggctttgagaaaaaaaacagaaacaagcgattatttcaaatcaaccaaccaactcagtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacatgcctttgttatggaacatttactgtgacagcagaatcgataatgcagtcatttccagccttgtgagctgacaccttcatgggtttgtggactttgtgactttttcttcctgtccccaaagtgccatatgctaccttaaaaaatattaaagtgaattcaaattaaaaaaaaaaat

SEQ ID NO: 279951 - DNA, 2270 bp, Homo sapiens
acacttttatattaacaagcattttgaaaaggctgagggcagatatgttagaagccatcttcttattcctaaattcatgcttaaatgtaattgtccttcagttttcccactcctgagtttggagtctgctggatgatgggtggtttggggaaggaaaagggttctgtacattggcctggcctgcaatacggctcgctatatttatatttcctacctggagaatgcctggactgttctccccatggaagttcttcaaggaagagcagcaggctcagctggccgcgggaggacactgagggcatcctgctcatctcacaccaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttcttggagagaaccgtttaaaaaattacaagatatatttaaaaagtaaccagataaaagtagcacatgtgcttttgttaaaaataaagttaaaagttaaagttaaaaaatgaagttaaaagtttcatcagaaactttacatatctttagcaaatatatttttatatgtgtatggcatataatggaaataattctttgagcaacagaagctattattaactactgcaagctaagccgagcttaaaaatgccttttgttttaaatgggctttgagaaaaaaaacagaaacaagcgattatttcaaatcaaccaaccaactcagtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacatgcctttgttatggaacatttactgtgacagcagaatcgataatgcagtcatttccagccttgtgagctgacaccttcatgggtttgtggactttgtgactttttcttcctgtccccaaagtgccatatgctaccttaaaaaatattaaagtgaattcaaattaaaaaaaaaaat

SEQ ID NO: 279952 - DNA, 2896 bp, Homo sapiens
  misc_feature (40)..(40): n is a, c, g, or t
  misc_feature (42)..(42): n is a, c, g, or t
agaggatcgcttagagctggttttctccccatggaagtcntnaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttcttggagagaaccgtttaaaaaattacaagatatatttaaaaagtaaccagataaaagtagcacatgtgcttttgttaaaaataaagttaaaagttaaagttaaaaaatgaagttaaaagtttcatcagaaactttacatatctttagcaaatatatttttatatgtgtatggcatataatggaaataattctttgagcaacagaagctattattaactactgcaagctaagccgagcttaaaaatgccttttgttttaaatgggctttgagaaaaaaaacagaaacaagcgattatttcaaatcaaccaaccaactcagtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacatgcctttgttatggaacatttactgtgacagcagaatcgataatgcagtcatttccagccttgtgagctgacaccttcatgggtttgtggactttgtgactttttcttcctgtccccaaagtgccatatgctaccttaaaaaatattaaagtgaattcaaattaaaaaaaaaaat

SEQ ID NO: 279953 - DNA, 3632 bp, Homo sapiens
tggtagttgtcataataggagaatttttcagtgcctcttctgtcacaatcgtagacacggtcacactccagtatctgggaaaacacagagatcgctatgggttgcagcgcatgtggggctccctgggctggggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggacttaatcaagctgctctgcagcgtgcagtatggctcagtgctgtttgtggcttggttcatgggttttggatatggcttcgtgttcacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacagttgcacataggaaaggagatgaaaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttcttggagagaaccgtttaaaaaattacaagatatatttaaaaagtaaccagataaaagtagcacatgtgcttttgttaaaaataaagttaaaagttaaagttaaaaaatgaagttaaaagtttcatcagaaactttacatatctttagcaaatatatttttatatgtgtatggcatataatggaaataattctttgagcaacagaagctattattaactactgcaagctaagccgagcttaaaaatgccttttgttttaaatgggctttgagaaaaaaaacagaaacaagcgattatttcaaatcaaccaaccaactcagtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacatgcctttgttatggaacatttactgtgacagcagaatcgataatgcagtcatttccagccttgtgagctgacaccttcatgggtttgtggactttgtgactttttcttcctgtccccaaagtgccatatgctaccttaaaaaatattaaagtgaattcaaattaaaaaaaaaaat

SEQ ID NO: 279954 - DNA, 2546 bp, Homo sapiens
tggtagttgtcataataggagaatttttcagtgcctcttctgtcacaatcgtagacacggtcacactccagtatctgggaaaacacagagatcgctatgggttgcagcgcatgtggggctccctgggctggggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggaactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttcttggagagaaccgtttaaaaaattacaagatatatttaaaaagtaaccagataaaagtagcacatgtgcttttgttaaaaataaagttaaaagttaaagttaaaaaatgaagttaaaagtttcatcagaaactttacatatctttagcaaatatatttttatatgtgtatggcatataatggaaataattctttgagcaacagaagctattattaactactgcaagctaagccgagcttaaaaatgccttttgttttaaatgggctttgagaaaaaaaacagaaacaagcgattatttcaaatcaaccaaccaactcagtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacatgcctttgttatggaacatttactgtgacagcagaatcgataatgcagtcatttccagccttgtgagctgacaccttcatgggtttgtggactttgtgactttttcttcctgtccccaaagtgccatatgctaccttaaaaaatattaaagtgaattcaaattaaaaaaaaaaat

SEQ ID NO: 279955 - DNA, 3038 bp, Homo sapiens
tggtagttgtcataataggagaatttttcagtgcctcttctgtcacaatcgtagacacggtcacactccagtatctgggaaaacacagagatcgctatgggttgcagcgcatgtggggctccctgggctggggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggacttaatcaagctgctctgcagcgtgcagtatggctcagtgctgtttgtggcttggttcatgggttttggatatggcttcgtgttcacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttcttggagagaaccgtttaaaaaattacaagatatatttaaaaagtaaccagataaaagtagcacatgtgcttttgttaaaaataaagttaaaagttaaagttaaaaaatgaagttaaaagtttcatcagaaactttacatatctttagcaaatatatttttatatgtgtatggcatataatggaaataattctttgagcaacagaagctattattaactactgcaagctaagccgagcttaaaaatgccttttgttttaaatgggctttgagaaaaaaaacagaaacaagcgattatttcaaatcaaccaaccaactcagtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcactcgaaacccgggtcctctggcgcccg

SEQ ID NO: 279956 - DNA, 1364 bp, Homo sapiens
ctctagaaggagtccccaagatacgtgtgtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacatgcctttgttatggaacatttactgtgacagcagaatcgataatgcagtcatttccagccttgtgagctgacaccttcatgggtttgtggactttgtgactttttcttcctgtccccaaagtgccatatgctaccttaaaaaatattaaagtgaattcaaattaaaaaaaaaaat

SEQ ID NO: 279957 - DNA, 1177 bp, Homo sapiens
acccacgcgtcgcccacgcgtccggatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacatgcctttgttatggaacatttactgtgacagcagaatcgataatgcagtcatttccagccttgtgagctgacaccttcatgggtttgtggactttgtgactttttcttcctgtccccaaagtgccatatgctaccttaaaaaatattaaagtgaattcaaattaaaaaaaaaaat

SEQ ID NO: 279958 - DNA, 1729 bp, Homo sapiens
tggtagttgtcataataggagaatttttcagtgcctcttctgtcacaatcgtagacacggtcacactccagtatctgggaaaacacagagatcgctatgggttgcagcgcatgtggggctccctgggctggggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggacttaatcaagctgctctgcagcgtgcagtatggctcagtgctgtttgtggcttggttcatgggttttggatatggcttcgtgttcacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacaggtgtatcttacaaaagtattactagtgatgaactagagggaaactggtccatcaccccagacagtctgagaagcactgacaagagccgcagactacagtgtccattgctgcggggcacaaatgactgaatgaagtcaacttgaaggtcgcatgtcaggcagtactcgggt

SEQ ID NO: 279959 - DNA, 2002 bp, Homo sapiens
tggtagttgtcataataggagaatttttcagtgcctcttctgtcacaatcgtagacacggtcacactccagtatctgggaaaacacagagatcgctatgggttgcagcgcatgtggggctccctgggctggggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggacttaatcaagctgctctgcagcgtgcagtatggctcagtgctgtttgtggcttggttcatgggttttggatatggcttcgtgttcacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacaggtgtatcttacaaaagtattactagtgatgaactagagggaaactggtccatcaccccagacagtctgagaagcactgacaagagccgcagactacagtgtccattgctgcggggcacaaatgactggtatgtgtataacatcagcagatgtagtcacctcttgaatgccttatccatggggtcatttccttcactttcttaaaaagatggtaataaataaaggaagtagaatatgagccctggaagcagacatatgggggcttgaattctgattctaccactttagctatatgtgtccttcagcaactttctcctaccttctctgggtctttcctcatctgtaaaatgaaaataccaaaacatatcacagagtggtcatgaggtgcaaattaagaggtatcgaaggtgcctcatatagtgcctgatggatctctagtcaatg

SEQ ID NO: 279960 - DNA, 534 bp, Homo sapiens
tttgggtatatgggattcttggtttatttatttatttttacctttgttcaaatatgtagaaaatgctgaaaaaatagtttaaacattcttttctctccagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggtacagttcctttgctgggctagcaatattacctgtcactcaagataccttaactgggctcagttttaattactcacttttcattcaacaagatttattgaaagtctggtgggggaaatagacatgcaaacaatttcagtactctgtgagcac

SEQ ID NO: 279961 - DNA, 587 bp, Homo sapiens
  misc_feature (40)..(40): n is a, c, g, or t
  misc_feature (42)..(42): n is a, c, g, or t
agaggatcgcttagagctggttttctccccatggaagtcntnaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaaggaacaccgggatcctctagaacactc

SEQ ID NO: 279962 - DNA, 3360 bp, Homo sapiens
tggtagttgtcataataggagaatttttcagtgcctcttctgtcacaatcgtagacacggtcacactccagtatctgggaaaacacagagatcgctatgggttgcagcgcatgtggggctccctgggctggggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggacttaatcaagctgctctgcagcgtgcagtatggctcagtgctgtttgtggcttggttcatgggttttggatatggcttcgtgttcacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttcttggagagaaccgtttaaaaaattacaagatatatttaaaaagtaaccagataaaagtagcacatgtgcttttgttaaaaataaagttaaaagttaaagttaaaaaatgaagttaaaagtttcatcagaaactttacatatctttagcaaatatatttttatatgtgtatggcatataatggaaataattctttgagcaacagaagctattattaactactgcaagctaagccgagcttaaaaatgccttttgttttaaatgggctttgagaaaaaaaacagaaacaagcgattatttcaaatcaaccaaccaactcagtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccattttta

SEQ ID NO: 279963 - DNA, 3322 bp, Homo sapiens
tggtagttgtcataataggagaatttttcagtgcctcttctgtcacaatcgtagacacggtcacactccagtatctgggaaaacacagagatcgctatgggttgcagcgcatgtggggctccctgggctggggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggacttaatcaagctgctctgcagcgtgcagtatggctcagtgctgtttgtggcttggttcatgggttttggatatggcttcgtgttcacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttcttggagagaaccgtttaaaaaattacaagatatatttaaaaagtaaccagataaaagtagcacatgtgcttttgttaaaaataaagttaaaagttaaagttaaaaaatgaagttaaaagtttcatcagaaactttacatatctttagcaaatatatttttatatgtgtatggcatataatggaaataattctttgagcaacagaagctattattaactactgcaagctaagccgagcttaaaaatgccttttgttttaaatgggctttgagaaaaaaaacagaaacaagcgattatttcaaatcaaccaaccaactcagtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacatgcctttgttatggaacatttactgtgacagcagaatcgataatgcagtcatttccagccttgtgagctgacaccttcatgggtttgtggactttgtgactttttcttcctgtccccaaagtgccatatgctaccttaaaaaatattaaagtgaattcaaattaaaaaaaaaaat

SEQ ID NO: 279964 - DNA, 2690 bp, Homo sapiens
tttgggtatatgggattcttggtttatttatttatttttacctttgttcaaatatgtagaaaatgctgaaaaaatagtttaaacattcttttctctccagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttcttggagagaaccgtttaaaaaattacaagatatatttaaaaagtaaccagataaaagtagcacatgtgcttttgttaaaaataaagttaaaagttaaagttaaaaaatgaagttaaaagtttcatcagaaactttacatatctttagcaaatatatttttatatgtgtatggcatataatggaaataattctttgagcaacagaagctattattaactactgcaagctaagccgagcttaaaaatgccttttgttttaaatgggctttgagaaaaaaaacagaaacaagcgattatttcaaatcaaccaaccaactcagtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacatgcctttgttatggaacatttactgtgacagcagaatcgataatgcagtcatttccagccttgtgagctgacaccttcatgggtttgtggactttgtgactttttcttcctgtccccaaagtgccatatgctaccttaaaaaatattaaagtgaattcaaattaaaaaaaaaaat

SEQ ID NO: 279965 - DNA, 2336 bp, Homo sapiens
tggtagttgtcataataggagaatttttcagtgcctcttctgtcacaatcgtagacacggtcacactccagtatctgggaaaacacagagatcgctatgggttgcagcgcatgtggggctccctgggctggggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggacttaatcaagctgctctgcagcgtgcagtatggctcagtgctgtttgtggcttggttcatgggttttggatatggcttcgtgttcacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaagtgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacatgcctttgttatggaacatttactgtgacagcagaatcgataatgcagtcatttccagccttgtgagctgacaccttcatgggtttgtggactttgtgactttttcttcctgtccccaaagtgccatatgctaccttaaaaaatattaaagtgaattcaaattaaaaaaaaaaat

SEQ ID NO: 279966 - DNA, 1309 bp, Homo sapiens
tggtagttgtcataataggagaatttttcagtgcctcttctgtcacaatcgtagacacggtcacactccagtatctgggaaaacacagagatcgctatgggttgcagcgcatgtggggctccctgggctggggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggacttaatcaagctgctctgcagcgtgcagtatggctcagtgctgtttgtggcttggttcatgggttttggatatggcttcgtgttcacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatatttatatttcctacctggagaatgcctggactgttctccccatggaagttcttcaaggtaagttaacagctgggattgaaattatttctctgccttccctgagctgtggctaaaagcccagtggccttcagcatctgattctataaaggaagggcaggcctactgtttcatgtgattttgaagtggttgttaaggaagagatgacatcaggagggatggttccttggttacctgagtgctgctttgtgttgagccaaacaaagctggacttgatccacacccttgtgattaaacaaaggaagaggaactctagaataaactcctgtgcacaactattagacatggacatccaagggtggttttaagatataaaaatatttatcttttaaagtttttggtggttttagttttgtagggtaactatagttactgaaaaaaagattgttgccataattattttatctcttcaggtatttttatcacatctggtgacttataactaaagttttatagccacaccgttgtttttccatgaactttaaaaaatctctgctcaaatgtcctcgccctgagttctttttgcttaagtatcctgcttccatcaagacac

SEQ ID NO: 279967 - DNA, 791 bp, Homo sapiens
tacggctgcgagaagacacagactgtgcaacccccaaagcaggtctcctcactcaccgggatagatagaactatcggccccaattcctcagccctacctgcaaccaccgcttgccatggtttccttgtgggtggagggtactttcccgccccctggtttcgggcttgcccacgtggcttgctctggccatggaatgaagcagaaacgaaagcctgccagttctgagcctatgccggaagacgccttgggcggttccgcggtccctgtgcgcttccaccttcacccagaaggacttctctggtgcagccgctgcttcttcagccacggcccaaaaggatcggagccccctggccgatccgcaggtctgcagggagccacagagcgcagcggccggcccagcgttcaagcccaagcacaggcctgcgagaaccttgttccagccaccgtttgggatggttgattaggacttgttgctgtggcggtagctcaccaatccaatgcgtgcacccgctcctttattaggctatagggcccagtggctgcgacagggacctgatacaacagtgcgttaaataaggagcttattgagctatcatgtcgtaagccggtggagaagtccagggctagtgtgggggctccggcgggggctgtggcccccatccgcatggagcctccccacggttcacaggtctcggtcttcggagccttcagccccgtgagcccgaacagtccacacggcggcgccagaccctcttcccaacgccaccctttgtcgtcttctcgcagccgta

SEQ ID NO: 279968 - DNA, 393 bp, Homo sapiens
ttgcaggctgccaccctccaagtcctgcttctctccagagatgggcagaagcaccagcccttgcctggcaccagcattctcttcagggaattttgtctggttcaagaagtcataccccaacccaagagaaaccttggacatctctcataagacatccaagggacagagctcctgggagacctagagtgagctggagagtgaacaacataccccactgggaagtaagcagccctggattctgcctcttgctaactgattcgtttcgaaccctgtttttctatctgtaaaagggactgtaactcccctgcccctgcctagattctcatacctggagactagggggctaagaccccttctagagataaaaataaaagtcttaaagagaaagaccaa

SEQ ID NO: 279969 - DNA, 897 bp, Homo sapiens
gttgagggggtgttgagggcggagaaatgcaagtttcattacaaaagttaacgtaacaaagaatctggtagaagtgagttttggatagtaaaataagtttcgaactctggcacctttcaattttgtcgcactctccttgtttttgacaatgcaatcatatgcttctgctatgttaagcgtattcaacagcgatgattacagtccagctgtgcaagagaatattcccgctctccggagaagctcttccttcctttgcactgaaagctgtaactctaagtatcagtgtgaaacgggagaaaacagtaaaggcaacgtccaggatagagtgaagcgacccatgaacgcattcatcgtgtggtctcgcgatcagaggcgcaagatggctctagagaatcccagaatgcgaaactcagagatcagcaagcagctgggataccagtggaaaatgcttactgaagccgaaaaatggccattcttccaggaggcacagaaattacaggccatgcacagagagaaatacccgaattataagtatcgacctcgtcggaaggcgaagatgctgccgaagaattgcagtttgcttcccgcagatcccgcttcggtactctgcagcgaagtgcaactggacaacaggttgtacagggatgactgtacgaaagccacacactcaagaatggagcaccagctaggccacttaccgcccatcaacgcagccagctcaccgcagcaacgggaccgctacagccactggacaaagctgtaggacaatcgggtaacattggctacaaagacctacctagatgctcctttttacgataacttacagccctcactttcttatgtttagtttcaatattgttttcttttctctggctaataaaggccttattcatttca

SEQ ID NO: 279970 - DNA, 3546 bp, Homo sapiens
agccgcgccgcgctgccgctggcccctcagcaaccctcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctatttttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaaccca

SEQ ID NO: 279971 - DNA, 582 bp, Homo sapiens
gcatttgctttgctgaggctctctaaacaaatgaggaaaaggctgttgttcagaggtggtgactcatatgcagatggatggccacagtgcgctccatccctgccatctctctttgtcatcctctgtcttgcccatgctgcagtgccttgcagatttgtttatatgcatgactttgtcatctgttgctgagagctgaggaaaacctcctgactggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggtatgatcctgtagtcctcttgcctgctgacctttcctctgtccatagacctgggtgtacactcttggccagaaacttacctcagactggtaacctgcatctgtagctaggaccgtttttttttttttaaagatttataattatggaaaatttcaaatatatgcaaaagtaatgcaaatggtatatcaa

SEQ ID NO: 279972 - DNA, 2759 bp, Homo sapiens
tcgactctagaggtcccccctggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctatttttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaaccca

SEQ ID NO: 279973 - DNA, 2012 bp, Homo sapiens
  misc_feature (51)..(51): n is a, c, g, or t
  misc_feature (73)..(73): n is a, c, g, or t
  misc_feature (148)..(148): n is a, c, g, or t
actgggcctactgacctcccccctcctctgattcatggaatgaaacttgtncatgagttcttccagctccganccactttgctgcttctccaggaaggccttctgcatggtgagctggctgtacacgcggacgccctcctcgccgcanattttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctatttttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaaccca

SEQ ID NO: 279974 - DNA, 2034 bp, Homo sapiens
agccgcgccgcgctgccgctggcccctcagcaaccctcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggcccccccccctcgcgatggtttccttttttctcaacaacaagttttttagccctttttttcaccaaggggaaccctcataactggtcttacaacattcagaaaccaataagtttgcct

SEQ ID NO: 279975 - DNA, 922 bp, Homo sapiens
aaccaagaagcggaccgatgagatagcacggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaaccca

SEQ ID NO: 279976 - DNA, 737 bp, Homo sapiens
gcaagcgagcaggtgtcgacctagttctggacccagctggctgtgctctcagaaatcggccccatgatgggtccgattatttacttgtcattccctgaaacaggtgttcactgctgttcacaaggacgactctgggcagtactactgcattgcttccaatgacgcaggctcagccaggtgtgaggagcaggagatggaagtctgtgagtttcttttttgaagaggtttcatcgcaagactgggaagtgaatagaacattttaatttaatattataccatcagcttagagaactcttccgccatgggttagctttcttctggagctgcctaggtccaccagaacccactgcacagtgaagggaaggctgagaaaaccgagtccagataagcaggtcctcaaaacaaaaccttctgggatctgctggtgttgggaacgtggccagccttgcaactttcactgcaagtttagtaaactccattctttggtaattgatagaattatcaaaatgtaaggtggtgtcaggtctccagaaatttatccagttataaccctcttgtagaaaactgacagagttttagcccgagtaattttacctgcagacaaagcttagcccctagagtaatgttatctcagggctctggttcccctaatggaggggcgttgagaggagggtgggggcagagaggatgtgtccaaatcacttggggagcttttttttttcttaaaaaacaaaaaa

SEQ ID NO: 279977 - DNA, 3854 bp, Homo sapiens
agccgcgccgcgctgccgctggcccctcagcaaccctcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctatttttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaacccaaacattgcttcattctttgttatttgctcttacgttgggtttgtctcttcttcctagcatttcagtggttaggcatgcacactaaaaatgctatcaatcacccatccaccagggaagtcagtgctgggcaggaggtcagcctgtgtgctcaagagcagtgctgcgcctctccgccaccgagcccacctgtgttgcggttcccacttgggatggcagtgggcagatctcagtggcatcccatcccccaaaccaaccaacgcacatcatcactttgtacttttgcttttgtaatactgggattaaaaaac

SEQ ID NO: 279978 - DNA, 3509 bp, Homo sapiens
agccgcgccgcgctgccgctggcccctcagcaaccctcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctatttttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggctggagcgtgaatccccaacgctgagggtggggagccatccctctctaccaaggtggcaatgatggagggaacttgcatgctaagcat

SEQ ID NO: 279979 - DNA, 1689 bp, Homo sapiens
agccgcgccgcgctgccgctggcccctcagcaaccctcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttctttctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaaccca

SEQ ID NO: 279980 - DNA, 516 bp, Homo sapiens
actttgcttttgagtgttcagaaccaagatggttcttgctggaagggctccggagaagcagtaacggccttgtgggttgggctgcagcagagaaatggaccaaacctcccccagccttcatggcccaagccccatcctccctccccaactgactgctgctccaggcaggatggatggagcatgtgcggtgcctcccccgcaaaaatgatgacgaggttaaaggaaaaaataagttacattacagtttccaaaatggttctcgctctccgctgaagatgggccaccgttggggctgcaatgtgctcgcggtcccagcttgtgctttgcaagaagagggaatataactagactgttattttaggttaaaatagccaagagacagacgccttcgcctcaaaaatattctgagacacataaaagtagaaggaaacaagtctcttcagtcacaaaatgtcgtacatcccgcatatactagattcaattaatttaataaaatagaatatacatagagaaaaa

SEQ ID NO: 279981 - DNA, 732 bp, Homo sapiens
tcaacaaactataactgagcacttactctgtgctagaaacagcatttctgctttccaaggacctctaagttcatgtggaatcaagtggattatttctatttgtcgctgagagtgaaactctccaccctgatgttcttcgtgctttctgggaaatctcagaaaaatactaacctgctgaagagctgtcactccaactttccatcctggaaatgtatatagaagtttactacaagaagaaaaatagttgaaagctgtatttttttttttttggaggaaaacaatatcagctacacattaaaaagtgaaataataataggtgatatttattaagttcttactcttccacacactattctgatgattaagctaatgtcacaaggttagtaatattgtccagacaaattctaggtctcaaactaactactatgctatgccacctcattaagaaattaaatgtcctaagtggaaaaaaaaatacgtgtgtaaaaatcatgttatattacaggctacagtaaaaaaaatttaggactgcagtatctttatagaaacatcatgaaagggaataacttatattttaataaaaatattatttgcatgttatatgactgttatatgacaacagtaatgctgctctcaatttcagaagcaagtcatgaatgataaataacacatccatggagcaaacagaggtatctgaaatcattataattatcattaaaatattaaatcatg

SEQ ID NO: 279982 - DNA, 767 bp, Homo sapiens
tttttttttttgagacagggtctcactcagttgcctaggctgaattgcagtggcacaatcatagtttactgcagccttgacctcctgggctcaagtgatcctctcacctcagcctcccaagtaactgggatgacaggcatgtgccaccctacccggctgatttcatttttatttttgtagaaacggagtctcattttgcttcccaggctgatcttgaatcctgggctcaactgatcctcctgccttggcctcccaaagcactgggattacaggtttgagccaccgtgcctagccccttgaacaaaatcctaaaatccacaaagttctaaagactaaagttttacataacttatttgacggtaaaacctgacctgaactgaaatgcatattagtatttttcaattcagaattgctgatatatttgattatagggttctgcaatagatctctctaggaaatgttacataatatatagtatttaccactaatacagtttttaaaattcagaatattttggattccaaggcaaatccaatttcaaggtttgaggctaaagaactgtgcagtaatatctttgtattttaaaaaacaggtttatataattattttccctctacagctttcttgcaaaaagaaatgcaaccttctatcagttccattcacaaaaggagaaaggaaggaaggaaagaaggaaggaagcaaacaagccacaataaggctcatgtctttaacttctctctctaatagttaccaatctctcttttgcc

SEQ ID NO: 279983 - DNA, 497 bp, Homo sapiens
tttttttttttgagacagggtctcactcagttgcctaggctgaattgcagtggcacaatcatagtttactgcagccttgacctcctgggctcaagtgatcctctcacctcagcctcccaagtaactgggatgacaggcatgtgccaccctacccggctgatttcatttttatttttgtagaaacggagtctcattttgcttcccaggctgatcttgaatcctgggctcaactgatcctcctgccttggcctcccaaagcactgggattacaggtttgaggctaaagaactgtgcagtaatatctttgtattttaaaaaacaggtttatataattattttccctctacagctttcttgcaaaaagaaatgcaaccttctatcagttccattcacaaaaggagaaaggaaggaaggaaagaaggaaggaagcaaacaagccacaataaggctcatgtctttaacttctctctctaatagttaccaatctctcttttgcc

SEQ ID NO: 279984 - DNA, 376 bp, Homo sapiens
  misc_feature (374)..(374): n is a, c, g, or t
cctgtcaatcgctcttggcctgtcactcgtcctgtcactcgctcttggcccctgtcaatcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaactgccaacacccaatgagcgactgancg

SEQ ID NO: 279985 - DNA, 4863 bp, Homo sapiens
tgtcagttctggagacaccaggtgtgcgcgaggtgattcccatggaccctgagggctggtgatagactcgggtcaacgggtggggaccgggtgtctcaggccccaggcaggcccggcccttcctgacatgacaccccttcccccagattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 279986 - DNA, 5518 bp, Homo sapiens
gacagtcaggcatctctgcctgggaccttctcgcacatccctccttctccctggacctctcttcactcccctagcctctgcccgtggtctccctgtttctcaaacacgtggtccccttccccgtgaaggtggctccaaggctggcagcccccgtgtccctggctggggagcggtggacctgccccagagctgtggctgtggtgggctccgggcagggccagggggcactgtggcctgggagggggcactgatgcctggcctcttgccagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 279987 - DNA, 3213 bp, Homo sapiens
cttaaggatccagtgctactaccacaaacaggagctcctgcagggcggcgaagtgcacaggggcgtgctggatcagctgtacacaagccaggccgaggccacgctgccaggccccaccgaggcccccaatgccccaagcaccgtgtccagtgggctgggcgcggaggagccactcagcagcatgacagacgacatgggcagccccctgagcaccggctaccacacgcgcagtggcagtgaggaggcagtcaccgaccccggggagcgtgaggctggtgcctctctgtaccagggactgatgcggacggccagcgagctgctcctggacaggcgcctgcgcatcccagagctggaggaggcagagctgtttgcggaggggcagggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 279988 - DNA, 8821 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaaggtgcctgggcccagggcgggggccgggacaagggccagggatatgccctctccctaagacagaggcactgctgccacgagaacccgtggtgctggaggccctcccagggctcggagcccatggggacatgaggcgagcccacccactagctgatcacgaggccagtgatcttggcagctgcgagtgagtgctgggcgcagaagtgggcagcggagttggtcctgttccaggcaggctggcagcagagcagggcctggtgcagggaggaccggacagccactgtttgctgcattcttgtttaatggcctttctcagagagaattcgtgcgtcagaccactcccccacgtaaaaagtacaactcaggggtttctagtggattcacagttgagcatctgccttctcaccacttcaaaaagaaaccccgggccgggcacagcggctcacccctatcatcccagcactgtaagagacccaggagggaggtactgctcaaggccaggagttcaagatctgcacggccacaagcgagaccctgcctcagcaaatgtaaaaataaaacaattagctggcaatggcagctcatgcctatggtcccagcactttgggaggccaaaggaggaggatcagttgaggccaggagttttaagaccagcctgggcaacatagtgagtgagactctctctacaaaaaataaacgttagctgggtgtgatggtgcacacttgtgctcccagctactctggaggctgaggtgggaggatggcttgaggccaggagtacagggctgcattaagcctgatcacaccactgcactccagcttgggcaacagagtgagaccctgtctctaaaaaagcaaaaagaagaaacccagtgcccattggctgtcactcggtttcccctcccctgggccctagtaaccccttgtctaggtcctggttctatgagatttgcctacagtggatatttcatgaaaacaggctcagacagcgtttgtccttttgtaatcagctttcctcgctcagcatggtgtctctgaggtccacccacgtggcagtatggccttcctgtttatgggcaaatgatattctgtggcatggatggaccacaacatgctcatctgttgatgggctgttgcccgtgatgctgccaggcacgccggtgtacacgtctgtgtgcccgtgcccctggtcctgtggctgcacgccagggccggtaagtgctggtggtggtttccatcatgaggagctgctggttttccatagcagctccaccatctaaggttcccaccaccaacacgaggttgcggtttctccacatcctcaacaacctgttactatgtcttttttgttctggccatgctgctgaacgggtagcttgctgtgggctcttctcagttccctgttgaccgacgctgagcgtcttttcatgtgcttggccatttgtgtatcttctctggggaaatgtctattcaaatcctttctccatagtttagttgggcttttgagataggatctcaggctgaagtgcagtggcatgaccttcactcactgtagcctctgcctcccaggttcaagcgattctcccacctcagcctcccgagtagctgggactacaggtgtgcaccaccaggcctggctagtcttttgtatttttggccaggttcgtctcaaactcctgacctcaaagtgctgggatgacaagtgtgagccgccacacccagcagttgggttgttttttattagagttttttctgtttttctgcagatacattggctagaaatgactgaattggaagaattctctgtattctctggttgctagaaccttatcaattaaaatttgcagaaaatttctccaattctatggactgtctcttaaattttcttggtgtctttggaagcacaaagtatttattttggtaatatctggtttactttgtttccttcgccaaatccaggttcatgaagatttgcccgttttcttctaaaagttctatagttttagctctgaagtttcgctctttgatccactttgaggtaaattttggcacatggtatgaggcaggagttgcgtttcattctcctgcctggggcggtgcctgcaccgtgttgaaaaaggttgtccgttcccactgaacggtcacagctcccttgtctaagatcaacgacccctgaacatgagggttccaactggactcttagttctactccactggcctgtgtctgcccaccattactaccgccgtgccatactgaggtcaggctggggcttttctgggctgctgggtgagctggagaatgcggttgtgtgacccgcaggaagggcagagctgagcgtatgacctgtgtcgttcccctccagaaaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 279989 - DNA, 7962 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaaggtgcctgggcccagggcgggggccgggacaagggccagggatatgccctctccctaagacagaggcactgctgccacgagaacccgtggtgctggaggccctcccagggctcggagcccatggggacatgaggcgagcccacccactagctgatcacgaggccagtgatcttggcagctgcgagtgagtgctgggcgcagaagtgggcagcggagttggtcctgttccaggcaggctggcagcagagcagggcctggtgcagggaggaccggacagccactgtttgctgcattcttgtttaatggcctttctcagagagaattcgtgcgtcagaccactcccccacgtaaaaagtacaactcaggggtttctagtggattcacagttgagcatctgccttctcaccacttcaaaaagaaaccccgggccgggcacagcggctcacccctatcatcccagcactgtaagagacccaggagggaggtactgctcaaggccaggagttcaagatctgcacggccacaagcgagaccctgcctcagcaaatgtaaaaataaaacaattagctggcaatggcagctcatgcctatggtcccagcactttgggaggccaaaggaggaggatcagttgaggccaggagttttaagaccagcctgggcaacatagtgagtgagactctctctacaaaaaataaacgttagctgggtgtgatggtgcacacttgtgctcccacctcccgagtagctgggactacaggtgtgcaccaccaggcctggctagtcttttgtatttttggccaggttcgtctcaaactcctgacctcaaagtgctgggatgacaagtgtgagccgccacacccagcagttgggttgttttttattagagttttttctgtttttctgcagatacattggctagaaatgactgaattggaagaattctctgtattctctggttgctagaaccttatcaattaaaatttgcagaaaatttctccaattctatggactgtctcttaaattttcttggtgtctttggaagcacaaagtatttattttggtaatatctggtttactttgtttccttcgccaaatccaggttcatgaagatttgcccgttttcttctaaaagttctatagttttagctctgaagtttcgctctttgatccactttgaggtaaattttggcacatggtatgaggcaggagttgcgtttcattctcctgcctggggcggtgcctgcaccgtgttgaaaaaggttgtccgttcccactgaacggtcacagctcccttgtctaagatcaacgacccctgaacatgagggttccaactggactcttagttctactccactggcctgtgtctgcccaccattactaccgccgtgccatactgaggtcaggctggggcttttctgggctgctgggtgagctggagaatgcggttgtgtgacccgcaggaagggcagagctgagcgtatgacctgtgtcgttcccctccagaaaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 279990 - DNA, 8896 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaaggtgcctgggcccagggcgggggccgggacaagggccagggatatgccctctccctaagacagaggcactgctgccacgagaacccgtggtgctggaggccctcccagggctcggagcccatggggacatgaggcgagcccacccactagctgatcacgaggccagtgatcttggcagctgcgagtgagtgctgggcgcagaagtgggcagcggagttggtcctgttccaggcaggctggcagcagagcagggcctggtgcagggaggaccggacagccactgtttgctgcattcttgtttaatggcctttctcagagagaattcgtgcgtcagaccactcccccacgtaaaaagtacaactcaggggtttctagtggattcacagttgagcatctgccttctcaccacttcaaaaagaaaccccgggccgggcacagcggctcacccctatcatcccagcactgtaagagacccaggagggaggtactgctcaaggccaggagttcaagatctgcacggccacaagcgagaccctgcctcagcaaatgtaaaaataaaacaattagctggcaatggcagctcatgcctatggtcccagcactttgggaggccaaaggaggaggatcagttgaggccaggagttttaagaccagcctgggcaacatagtgagtgagactctctctacaaaaaataaacgttagctgggtgtgatggtgcacacttgtgctcccagctactctggaggctgaggtgggaggatggcttgaggccaggagtacagggctgcattaagcctgatcacaccactgcactccagcttgggcaacagagtgagaccctgtctctaaaaaagcaaaaagaagaaacccagtgcccattggctgtcactcggtttcccctcccctgggccctagtaaccccttgtctaggtcctggttctatgagatttgcctacagtggatatttcatgaaaacaggctcagacagcgtttgtccttttgtaatcagctttcctcgctcagcatggtgtctctgaggtccacccacgtggcagtatggccttcctgtttatgggcaaatgatattctgtggcatggatggaccacaacatgctcatctgttgatgggctgttgcccgtgatgctgccaggcacgccggtgtacacgtctgtgtgcccgtgcccctggtcctgtggctgcacgccagggccggtaagtgctggtggtggtttccatcatgaggagctgctggttttccatagcagctccaccatctaaggttcccaccaccaacacgaggttgcggtttctccacatcctcaacaacctgttactatgtcttttttgttctggccatgctgctgaacgggtagcttgctgtgggctcttctcagttccctgttgaccgacgctgagcgtcttttcatgtgcttggccatttgtgtatcttctctggggaaatgtctattcaaatcctttctccatagtttagttgggcttttgagataggatctcaggctgaagtgcagtggcatgaccttcactcactgtagcctctgcctcccaggttcaagcgattctcccacctcagcctcccgagtagctgggactacaggtgtgcaccaccaggcctggctagtcttttgtatttttggccaggttcgtctcaaactcctgacctcaaagtgctgggatgacaagtgtgagccgccacacccagcagttgggttgttttttattagagttttttctgtttttctgcagatacattggctagaaatgactgaattggaagaattctctgtattctctggttgctagaaccttatcaattaaaatttgcagaaaatttctccaattctatggactgtctcttaaattttcttggtgtctttggaagcacaaagtatttattttggtaatatctggtttactttgtttccttcgccaaatccaggttcatgaagatttgcccgttttcttctaaaagttctatagttttagctctgaagtttcgctctttgatccactttgaggtaaattttggcacatggtatgaggcaggagttgcgtttcattctcctgcctggggcggtgcctgcaccgtgttgaaaaaggttgtccgttcccactgaacggtcacagctcccttgtctaagatcaacgacccctgaacatgagggttccaactggactcttagttctactccactggcctgtgtctgcccaccattactaccgccgtgccatactgaggtcaggctggggcttttctgggctgctgggtgagctggagaatgcggttgtgtgacccgcaggaagggcagagctgagcgtatgacctgtgtcgttcccctccagaaaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagaggttcgtcctggacttggggcagtgcctgggtgggtggacccactacagtgggtcacgctgtgttcccacccccagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 279991 - DNA, 5898 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaatacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 279992 - DNA, 6457 bp, Homo sapiens
  misc_feature (5846)..(5847): n is a, c, g, or t
  misc_feature (5849)..(5849): n is a, c, g, or t
  misc_feature (5863)..(5863): n is a, c, g, or t
  misc_feature (5875)..(5875): n is a, c, g, or t
  misc_feature (5890)..(5890): n is a, c, g, or t
  misc_feature (5892)..(5892): n is a, c, g, or t
  misc_feature (5904)..(5905): n is a, c, g, or t
  misc_feature (5908)..(5908): n is a, c, g, or t
  misc_feature (5911)..(5912): n is a, c, g, or t
  misc_feature (5915)..(5916): n is a, c, g, or t
  misc_feature (5919)..(5919): n is a, c, g, or t
  misc_feature (5924)..(5924): n is a, c, g, or t
  misc_feature (5934)..(5935): n is a, c, g, or t
  misc_feature (5945)..(5945): n is a, c, g, or t
  misc_feature (5951)..(5952): n is a, c, g, or t
  misc_feature (5954)..(5955): n is a, c, g, or t
  misc_feature (5957)..(5957): n is a, c, g, or t
  misc_feature (5969)..(5969): n is a, c, g, or t
  misc_feature (5972)..(5973): n is a, c, g, or t
  misc_feature (5975)..(5975): n is a, c, g, or t
  misc_feature (5987)..(5987): n is a, c, g, or t
  misc_feature (5989)..(5989): n is a, c, g, or t
  misc_feature (5998)..(5998): n is a, c, g, or t
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggaaaaagaaaagaannantaaaggaaaaaaanaaaaaaaaagcnaaaggaaaaaaaaantnaaaaggtcagcnnacngannaannganaaatngatggaaaannaaaaaagggnaagaannanncnaaagtgatggtnaanngnaaaattgagagngnaaaaaaaancgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 279993 - DNA, 1146 bp, Homo sapiens
gccctgtgaaagctggtgtggggaggcggctgcagtcactgagggtgtcacttgtacccagctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 279994 - DNA, 5331 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccagggatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 279995 - DNA, 7641 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaaggtgcctgggcccagggcgggggccgggacaagggccagggatatgccctctccctaagacagaggcactgctgccacgagaacccgtggtgctggaggccctcccagggctcggagcccatggggacatgaggcgagcccacccactagctgatcacgaggccagtgatcttggcagctgcgagtgagtgctgggcgcagaagtgggcagcggagttggtcctgttccaggcaggctggcagcagagcagggcctggtgcagggaggaccggacagccactgtttgctgcattcttgtttaatggcctttctcagagagaattcgtgcgtcagaccactcccccacgtaaaaagtacaactcaggggtttctagtggattcacagttgagcatctgccttctcaccacttcaaaaagaaaccccgggccgggcacagcggctcacccctatcatcccagcactgtaagagacccaggagggaggtactgctcaaggccaggagttcaagatctgcacggccacaagcgagaccctgcctcagcaaatgtaaaaataaaacaattagctggcaatggcagctcatgcctatggtcccagcactttgggaggccaaaggaggaggatcagttgaggccaggagttttaagaccagcctgggcaacatagtgagtgagactctctctacaaaaaataaacgttagctgggtgtgatggtgcacacttgtgctcccagctactctggaggctgaggtgggaggatggcttgaggccaggagtacagggctgcattaagcctgatcacaccactgcactccagcttgggcaacagagtgagaccctgtctctaaaaaagcaaaaagaagaaacccagtgcccattggctgtcactcggtttcccctcccctgggccctagtaaccccttgtctaggtcctggttctatgagatttgcctacagtggatatttcatgaaaacaggctcagacagcgtttgtccttttgtaatcagctttcctcgctcagcatggtgtctctgaggtccacccacgtggcagtatggccttcctgtttatgggcaaatgatattctgtggcatggatggaccacaacatgctcatctgttgatgggctgttgcccgtgatgctgccaggcacgccggtgtacacgtctgtgtgcccgtgcccctggtcctgtggctgcacgccagggccggtaagtgctggtggtggtttccatcatgaggagctgctggttttccatagcagctccaccatctaaggttcccaccaccaacacgaggttgcggtttctccacatcctcaacaacctgttactatgtcttttttgttctggccatgctgctgaacgggtagcttgctgtgggctcttctcagttccctgttgaccgacgctgagcgtcttttcatgtgcttggccatttgtgtatcttctctggggaaatgtctattcaaatcctttctccatagtttagttgggcttttgagataggatctcaggctgaagtgcagtggcatgaccttcactcactgtagcctctgcctcccaggttcaagcgattctcccacctcagcctcccgagtagctgggactacaggtgtgcaccaccaggcctggctagtcttttgtatttttggccaggttcgtctcaaactcctgacctcaaagtgctgggatgacaagtgtgagccgccacacccagcagttgggttgttttttattagagttttttctgtttttctgcagatacattggctagaaatgactgaattggaagaattctctgtattctctggttgctagaaccttatcaattaaaatttgcagaaaatttctccaattctatggactgtctcttaaattttcttggtgtctttggaagcacaaagtatttattttggtaatatctggtttactttgtttccttcgccaaatccaggttcatgaagatttgcccgttttcttctaaaagttctatagttttagctctgaagtttcgctctttgatccactttgaggtaaattttggcacatggtatgaggcaggagttgcgtttcattctcctgcctggggcggtgcctgcaccgtgttgaaaaaggttgtccgttcccactgaacggtcacagctcccttgtctaagatcaacgacccctgaacatgagggttccaactggactcttagttctactccactggcctgtgtctgcccaccattactaccgccgtgccatactgaggtcaggctggggcttttctgggctgctgggtgagctggagaatgcggttgtgtgacccgcaggaagggcagagctgagcgtatgacctgtgtcgttcccctccagaaaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgaagccagagcagtgaaggagtcagttctctcag

SEQ ID NO: 279996 - DNA, 815 bp, Homo sapiens
gttatcctatcgtcgacccacgcgctccgggcccaagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagcggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 279997 - DNA, 768 bp, Homo sapiens
catgagcgcccagcagccgtccatcatccccttcacggcccaggcctatgaggagctgtcccggcagtttgacccccagccggtaagtggcctctgccctgtgaaagctggtgtggggaggcggctgcagtcactgagggtgtcacttgtacccagctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagaggttcgtcctggacttggggcagtgcctgggtgggtggacccactacagtgggtcacgctgtgttcccacccccagggacctggcgaagggaggcactgtggagtatgccaacgagaagcacatgctggccctggcccccaacagcactgcacggcggcagctggccagcctgctcgagggcacctcggaccagtctgtgtgagtgaagggcccgggtggtgggcaggagggctgtgccaggttggctgggccaggcctgacctgccagcacctccctgcagggtcatccccaatctcttccccaagtacatccgtgcccccaacgggcccgaagccaaccctgtgaagcagctgcagcccagtgagtatgggcgtgggggttgggggaggctagagaggggtgacctgcggcctcaacgatcttctccctccatcccag

SEQ ID NO: 279998 - DNA, 144 bp, Homo sapiens
cactttccaccctgaccctccctgtagcctggggtcaggccatagagcaggattctctgtgactcggcttccctccccagtgggctgggcgcggaggagccactcagcagcatgacagacgacatgggcagccccctgagcacc

SEQ ID NO: 279999 - DNA, 6382 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgggctgggcgcggaggagccactcagcagcatgacagacgacatgggcagccccctgagcaccggctaccacacgcgcagtggcagtgaggaggcagtcaccgaccccggggagcgtgaggctggtgcctctctgtaccagggactgatgcggacggccagcgagctgctcctggacaggcgcctgcgcatcccagagctggaggaggcagagctgtttgcggaggggcagggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 280000 - DNA, 6457 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 280001 - DNA, 4256 bp, Homo sapiens
cacgagctcccccctgtaccgtcgctcttgcccgtgtactcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 280002 - DNA, 6558 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttggggtgagccaggcccgggacccaaacccagtgtacgcagagctcagcagccacccacatcccctgggcttggctccccctgacctgtgctctcctggccacagaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 280003 - DNA, 8904 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccagggggggtgagtgcaggtccgccggggtgggggtcacggcccgggcatgagggagcccacctgacgggaaccctggctgtgggcaggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaaggtgcctgggcccagggcgggggccgggacaagggccagggatatgccctctccctaagacagaggcactgctgccacgagaacccgtggtgctggaggccctcccagggctcggagcccatggggacatgaggcgagcccacccactagctgatcacgaggccagtgatcttggcagctgcgagtgagtgctgggcgcagaagtgggcagcggagttggtcctgttccaggcaggctggcagcagagcagggcctggtgcagggaggaccggacagccactgtttgctgcattcttgtttaatggcctttctcagagagaattcgtgcgtcagaccactcccccacgtaaaaagtacaactcaggggtttctagtggattcacagttgagcatctgccttctcaccacttcaaaaagaaaccccgggccgggcacagcggctcacccctatcatcccagcactgtaagagacccaggagggaggtactgctcaaggccaggagttcaagatctgcacggccacaagcgagaccctgcctcagcaaatgtaaaaataaaacaattagctggcaatggcagctcatgcctatggtcccagcactttgggaggccaaaggaggaggatcagttgaggccaggagttttaagaccagcctgggcaacatagtgagtgagactctctctacaaaaaataaacgttagctgggtgtgatggtgcacacttgtgctcccagctactctggaggctgaggtgggaggatggcttgaggccaggagtacagggctgcattaagcctgatcacaccactgcactccagcttgggcaacagagtgagaccctgtctctaaaaaagcaaaaagaagaaacccagtgcccattggctgtcactcggtttcccctcccctgggccctagtaaccccttgtctaggtcctggttctatgagatttgcctacagtggatatttcatgaaaacaggctcagacagcgtttgtccttttgtaatcagctttcctcgctcagcatggtgtctctgaggtccacccacgtggcagtatggccttcctgtttatgggcaaatgatattctgtggcatggatggaccacaacatgctcatctgttgatgggctgttgcccgtgatgctgccaggcacgccggtgtacacgtctgtgtgcccgtgcccctggtcctgtggctgcacgccagggccggtaagtgctggtggtggtttccatcatgaggagctgctggttttccatagcagctccaccatctaaggttcccaccaccaacacgaggttgcggtttctccacatcctcaacaacctgttactatgtcttttttgttctggccatgctgctgaacgggtagcttgctgtgggctcttctcagttccctgttgaccgacgctgagcgtcttttcatgtgcttggccatttgtgtatcttctctggggaaatgtctattcaaatcctttctccatagtttagttgggcttttgagataggatctcaggctgaagtgcagtggcatgaccttcactcactgtagcctctgcctcccaggttcaagcgattctcccacctcagcctcccgagtagctgggactacaggtgtgcaccaccaggcctggctagtcttttgtatttttggccaggttcgtctcaaactcctgacctcaaagtgctgggatgacaagtgtgagccgccacacccagcagttgggttgttttttattagagttttttctgtttttctgcagatacattggctagaaatgactgaattggaagaattctctgtattctctggttgctagaaccttatcaattaaaatttgcagaaaatttctccaattctatggactgtctcttaaattttcttggtgtctttggaagcacaaagtatttattttggtaatatctggtttactttgtttccttcgccaaatccaggttcatgaagatttgcccgttttcttctaaaagttctatagttttagctctgaagtttcgctctttgatccactttgaggtaaattttggcacatggtatgaggcaggagttgcgtttcattctcctgcctggggcggtgcctgcaccgtgttgaaaaaggttgtccgttcccactgaacggtcacagctcccttgtctaagatcaacgacccctgaacatgagggttccaactggactcttagttctactccactggcctgtgtctgcccaccattactaccgccgtgccatactgaggtcaggctggggcttttctgggctgctgggtgagctggagaatgcggttgtgtgacccgcaggaagggcagagctgagcgtatgacctgtgtcgttcccctccagaaaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 280004 - DNA, 7056 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagatacattggctagaaatgactgaattggaagaattctctgtattctctggttgctagaaccttatcaattaaaatttgcagaaaatttctccaattctatggactgtctcttaaattttcttggtgtctttggaagcacaaagtatttattttggtaatatctggtttactttgtttccttcgccaaatccaggttcatgaagatttgcccgttttcttctaaaagttctatagttttagctctgaagtttcgctctttgatccactttgaggtaaattttggcacatggtatgaggcaggagttgcgtttcattctcctgcctggggcggtgcctgcaccgtgttgaaaaaggttgtccgttcccactgaacggtcacagctcccttgtctaagatcaacgacccctgaacatgagggttccaactggactcttagttctactccactggcctgtgtctgcccaccattactaccgccgtgccatactgaggtcaggctggggcttttctgggctgctgggtgagctggagaatgcggttgtgtgacccgcaggaagggcagagctgagcgtatgacctgtgtcgttcccctccagaaaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 280005 - DNA, 8947 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaaggtgcctgggcccagggcgggggccgggacaagggccagggatatgccctctccctaagacagaggcactgctgccacgagaacccgtggtgctggaggccctcccagggctcggagcccatggggacatgaggcgagcccacccactagctgatcacgaggccagtgatcttggcagctgcgagtgagtgctgggcgcagaagtgggcagcggagttggtcctgttccaggcaggctggcagcagagcagggcctggtgcagggaggaccggacagccactgtttgctgcattcttgtttaatggcctttctcagagagaattcgtgcgtcagaccactcccccacgtaaaaagtacaactcaggggtttctagtggattcacagttgagcatctgccttctcaccacttcaaaaagaaaccccgggccgggcacagcggctcacccctatcatcccagcactgtaagagacccaggagggaggtactgctcaaggccaggagttcaagatctgcacggccacaagcgagaccctgcctcagcaaatgtaaaaataaaacaattagctggcaatggcagctcatgcctatggtcccagcactttgggaggccaaaggaggaggatcagttgaggccaggagttttaagaccagcctgggcaacatagtgagtgagactctctctacaaaaaataaacgttagctgggtgtgatggtgcacacttgtgctcccagctactctggaggctgaggtgggaggatggcttgaggccaggagtacagggctgcattaagcctgatcacaccactgcactccagcttgggcaacagagtgagaccctgtctctaaaaaagcaaaaagaagaaacccagtgcccattggctgtcactcggtttcccctcccctgggccctagtaaccccttgtctaggtcctggttctatgagatttgcctacagtggatatttcatgaaaacaggctcagacagcgtttgtccttttgtaatcagctttcctcgctcagcatggtgtctctgaggtccacccacgtggcagtatggccttcctgtttatgggcaaatgatattctgtggcatggatggaccacaacatgctcatctgttgatgggctgttgcccgtgatgctgccaggcacgccggtgtacacgtctgtgtgcccgtgcccctggtcctgtggctgcacgccagggccggtaagtgctggtggtggtttccatcatgaggagctgctggttttccatagcagctccaccatctaaggttcccaccaccaacacgaggttgcggtttctccacatcctcaacaacctgttactatgtcttttttgttctggccatgctgctgaacgggtagcttgctgtgggctcttctcagttccctgttgaccgacgctgagcgtcttttcatgtgcttggccatttgtgtatcttctctggggaaatgtctattcaaatcctttctccatagtttagttgggcttttgagataggatctcaggctgaagtgcagtggcatgaccttcactcactgtagcctctgcctcccaggttcaagcgattctcccacctcagcctcccgagtagctgggactacaggtgtgcaccaccaggcctggctagtcttttgtatttttggccaggttcgtctcaaactcctgacctcaaagtgctgggatgacaagtgtgagccgccacacccagcagttgggttgttttttattagagttttttctgtttttctgcagatacattggctagaaatgactgaattggaagaattctctgtattctctggttgctagaaccttatcaattaaaatttgcagaaaatttctccaattctatggactgtctcttaaattttcttggtgtctttggaagcacaaagtatttattttggtaatatctggtttactttgtttccttcgccaaatccaggttcatgaagatttgcccgttttcttctaaaagttctatagttttagctctgaagtttcgctctttgatccactttgaggtaaattttggcacatggtatgaggcaggagttgcgtttcattctcctgcctggggcggtgcctgcaccgtgttgaaaaaggttgtccgttcccactgaacggtcacagctcccttgtctaagatcaacgacccctgaacatgagggttccaactggactcttagttctactccactggcctgtgtctgcccaccattactaccgccgtgccatactgaggtcaggctggggcttttctgggctgctgggtgagctggagaatgcggttgtgtgacccgcaggaagggcagagctgagcgtatgacctgtgtcgttcccctccagaaaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgaggtgagcatgtgtgggtccgcctgtccattcccatcccctgggggttctggccaaggcggtgcaccacccccagccgctcctccacgctcatcttcgtggccccgtgtccccgtgcctgccccagccccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 280006 - DNA, 6498 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaaggttcatgaagatttgcccgttttcttctaaaagttctatagttttagctctgaagtttcgctctttgatccactttgagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaagcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 280007 - DNA, 1419 bp, Homo sapiens
gcaagcaggtttcgaggtgagaggatcagcaaaggagaggaagagggacaacaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 280008 - DNA, 5679 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcgttggatgcagtcaggggcgttggatgcagtcaggggcgttggatggcgtc

SEQ ID NO: 280009 - DNA, 5589 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagcggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaaaaaaaaaaca

SEQ ID NO: 280010 - DNA, 6160 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgtgggcttgtggctgctggagtgaagccactcaagcagcatgacatgactgaccattggtgcatgcccccctgagtcacctgtgctatcaacgacgctgcatgtggcatgtgaggagggcatgtcacctgaccccctgggggagctgttgagtgctcgggttgcctcttcttgtacgcacggggactcgattgcgggactgtgccatgccgacgcttgtgtccttgtgacatggcgcctcgctgcaattcccacgaagcttggcctggacgtgcgcaggagcttgtttgtgccggatgggcgccgtggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaaggtgcctgggcccagggcgggggccgggacaagggccagggatatgccctctccctaagacagaggcactgctgccacgagaacccgtggtgctggaggccctcccagggctcggagcccatggggacatgaggcgagcccacccactagctgatcacgaggccagtgatcttggcagctgcgagtgagtgctgggcgcagaagtgggcagcggagttggtcctgttccaggcaggctggcagcagagcagggcctggtgcagggaggaccggacagccactgtttgctgcattcttgtttaatggcctttctcagagagaattcgtgcgtcagaccactcccccacgtaaaaagtacaactcaggggtttctagtggattcacagttgagcatctgccttctcaccacttcaaaaagaaaccccgggccgggcacagcggctcacccctatcatcccagcactgtaagagacccaggagggaggtactgctcaaggccaggagttcaagatctgcacggccacaagcgagaccctgcctcagcaaatgtaaaaataaaacaattagctggcaatggcagctcatgcctatggtcccagcactttgggaggccaaaggaggaggatcagttgaggccaggagttttaagaccagcctgggcaacatagtgagtgagactctctctacaaaaaataaacgttagctgggtgtgatggtgcacacttgtgctcccagctactctggaggctgaggtgggaggatggcttgaggccaggagtacagggctgcattaagcctgatcacaccactgcactccagcttgggcaacagagtgagaccctgtctctaaaaaagcaaaaagaagaaacccagtgcccattggctgtcactcggtttcccctcccctgggccctagtaaccccttgtctaggtcctggttctatgagatttgcctacagtggatatttcatgaaaacaggctcagacagcgtttgtccttttgtaatcagctttcctcgctcagcatggtctccatctcagcctggtcaccatggtaccgagctcgattta

SEQ ID NO: 280011 - DNA, 755 bp, Homo sapiens
ggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacgggtgagtgagtggctggggggcaccccgcagctcggggggctccgggcggccccaggactcaccagcttcccccgcagcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttattt

SEQ ID NO: 280012 - DNA, 720 bp, Homo sapiens
ggcacgattacaggcttggttctgtttattgtcgcatcagcccttcagaatgctgtcagcaagactgctcacatttaaaggttgaagctgaagtactcattttacccatagcagaaacttcttacttataaagcaaaatataagttatttaattggaatttctagaaagtattggcaaagatgatgtttcttaaataaaataaatcagaaagaaaaaattacactctgccctgcttcttcctgcccattcatgatagacaatgtttatcttcacagcactcttcaacctcataccagtgggactacgtgttgttgccatccagggagtgaaaacagggttgtatatagccatgaatggagaaggttacctctacccatcagtaagtaagacgccaaagatctcggccattcgttcaatgcatgtaaaataacaatggcagcaacaacaaaaagaaagttctatgtctgttgtttctgccagtttttgccttagtatttgatctttgcgagaatgcttagaagctgtttattattcaccagtgtttagtaatatgagtttatctaaaggaagtgtaatactatgtcttaaatagtgcttttgccatattttaaaaaataacctagtatacacgtgaatctaatcttttgtatttctagttagaaatgcacttatcttagagagtttcttataatgtttttaaaagaaacaatatgaattct

SEQ ID NO: 280013 - DNA, 812 bp, Homo sapiens
ctatgtttgcctttcagatccccagctcaagggtatagtgaccaggttatattgcaggcaaggctactacttgcaaatgcaccccgatggagctctcgatggaaccaaggatgacagcactaattctacactcttcaacctcataccagtgggactacgtgttgttgccatccagggagtgaaaacagggttgtatatagccatgaatggagaaggttacctctacccatcagaactttttacccctgaatgcaagtttaaagaatctgtttttgaaaattattatgtaatctactcatccatgttgtacagacaacaggaatctggtagagcctggtttttgggattaaataaggaagggcaagctatgaaagggaacagagtaaagaaaaccaaaccagcagctcattttctacccaagccattggaagttgccatgtaccgagaaccatctttgcatgatgttggggaaacggtcccgaagcctggggtgacgccaagtaaaagcacaagtgcgtctgcaataatgaatggaggcaaaccagtcaacaagagtaagacaacatagccagatcctcacaggtgttgtgacttattcgtcctgagcacagttgagtgatttatcctcaccagacattcctgctccgtggctgaagagcagcaggaagtaagctaatgcttattctttgctgtctccgaacttctctgttgcaagtggataaatctcaacctgttgcaccccccacaacaagaagacacctggataaccagctaaactcagaccatggaatgccctaccagatatggaatgc

SEQ ID NO: 280014 - DNA, 988 bp, Homo sapiens
atggccgcggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgcaggttgcggcgccaagatccccagctcaagggtatagtgaccaggttatattgcaggcaaggctactacttgcaaatgcaccccgatggagctctcgatggaaccaaggatgacagcactaattctacactcttcaacctcataccagtgggactacgtgttgttgccatccagggagtgaaaacagggttgtatatagccatgaatggagaaggttacctctacccatcagaactttttacccctgaatgcaagtttaaagaatctgtttttgaaaattattatgtaatctactcatccatgttgtacagacaacaggaatctggtagagcctggtttttgggattaaataaggaagggcaagctatgaaagggaacagagtaaagaaaaccaaaccagcagctcattttctacccaagccattggaagttgccatgtaccgagaaccatctttgcatgatgttggggaaacggtcccgaagcctggggtgacgccaagtaaaagcacaagtgcgtctgcaataatgaatggaggcaaaccagtcaacaagagtaagacaacatagccagatcctcacaggtgttgtgacttattcgtcctgagcacagttgagtgatttatcctcaccagacattcctgctccgtggctgaagagcagcaggaagtaagctaatgcttattctttgctgtctccgaacttctctgttgcaagtggataaatctcaacctgttgcaccccccacaacaagaagacacctggataaccagctaaactcagaccatggaatgccctaccagatatggaatgc

SEQ ID NO: 280015 - DNA, 748 bp, Homo sapiens
atggccgcggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgcaggttgcggcgccaagatccccagctcaagggtatagtgaccaggttatattgcaggcaaggctactacttgcaaatgcaccccgatggagctctcgatggaaccaaggatgacagcactaattctacactcttcaacctcataccagtgggactacgtgttgttgccatccagggagtgaaaacagggttgtatatagccatgaatggagaaggttacctctacccatcagtaagtaagacgccaaagatctcggccattcgttcaatgcatgtaaaataacaatggcagcaacaacaaaaagaaagttctatgtctgttgtttctgccagtttttgccttagtatttgatctttgcgagaatgcttagaagctgtttattattcaccagtgtttagtaatatgagtttatctaaaggaagtgtaatactatgtcttaaatagtgcttttgccatattttaaaaaataacctagtatacacgtgaatctaatcttttgtatttctagttagaaatgcacttatcttagagagtttcttataatgtttttaaaagaaacaatatgaattct

SEQ ID NO: 280016 - DNA, 718 bp, Homo sapiens
caacgcctgatgaagcaacgttcccgccacagcatccaccttaaccttccaaatgccactgctgtgaagaggagccatcgcagatcgccatggcgacagagcccttctgacccaggggatccactgctctcaggcactgtccaaccgacacctggtgacagaggagcccgacagcctctggctgaccctctggagacagaagggcacacggctgccattttcgtcgatgcctcatcggggcagtcaggaagtgcacaggctgaatcacagattatcttcaggaacacaactgggtgacatggcaagtgcagtgaacaactcactctccaacatgcgccatcactatgctcaaaaggaacctattctcttctgttctatttactcattgcttcaactcatagaacccaaatggatgtgtgcagtgttcactaatatgaagaccctgaatcagagtcatagggagctgtgagagaattttctgcaacactggtattggctcatagcctgtgtccaataagggagctactggccacatgcagctattgtacacttgaaatgtgactagtggctacagaattagcacaactatgcatataagcataactaagcaataagcataactaagttagccttagaatagggataactccatcaccccaacttatatttctgggattacaggcacgcaccaccacacccagctaattttttttgtatt

SEQ ID NO: 280017 - DNA, 1347 bp, Homo sapiens
tatcggtctttccgctgctgctcccattgctgccaccagagccccctaacttcttgctccgctcaccgcgggaagtcgagtcctcaccaccacgggagcgtttggccttcactggcgagcgctcttttcccttcattgttgcgggtcgtcggaggtcgtctccgcggagctgagtaacccgccgccccgcgctcgtttcacacagcggaaccgcacgccgccatcttggactccgccgcggcacagggtcccgccccgcagtcctcattggccaattgctctctcttctacagtctcattgggaaaattatttgtctatctttacatctccccgcgctccaggaaggcgcccgcccaaccactgttattgggttcccaaccccctagtcggagtacctcattggttacatttgttgtctatcttaacggttcctcgcgccagactgtagctccgcccctcgcactctgcggtcacgtgacccaaagtgttgaggtgttgattggacaaaaagtctgccctgtaacggtacttcttgctcagtgacagcagcaacccacctccttatccctttcattggcttataaacccgtcctttaaaccactatttgggaggtcgggccatcagtttcggcgttttttccagagaggcaggctcacagcgatatcgcgagagacgggaattgctctgtcacgcaagctggagtgcagtggtgccatctcggctcactgtgacctctgcctcctgggctcaagccatcctcccacctcagcccttcaagtagctgggattacaggtcaccatcctctcactcgcctctgacttttcgcacaggagagagctggtcgaatagtacaattccccgatgtgaatggggagaagctggggaaaggaagaatgatcttcaggcagtaagggcccctactccagtatgattggtgtccttataaaaaggagaaattggacacagacaccctaccaagaagaacactatgtgaagatgaaggcagagatcagggtgatgcctctacttgctgagaaactcctacagttgccagcccaccactagaagcaaaggaagaagcacagccctcagaaggaaccaaccctgctaatgccttggtcttggacttgcagcctccagaacagcgagccaatacattcctgtggtttaagccactgactgtggcactttattacagcagcactaggaaactcatacaggaggtgacagtgctcagatgaaacaggaccttccacttccatggcaaagccctcatctttcgtgcccatgcgccatttgatctgcacacaaatcactgagcaggttcctcagctattattatcc

SEQ ID NO: 280018 - DNA, 891 bp, Homo sapiens
tatcggtctttccgctgctgctcccattgctgccaccagagccccctaacttcttgctccgctcaccgcgggaagtcgagtcctcaccaccacgggagcgtttggccttcactggcgagcgctcttttcccttcattgttgcgggtcgtcggaggtcgtctccgcggagctgagtaacccgccgccccgcgctcgtttcacacagcggaaccgcacgccgccatcttggactccgccgcggcacagggtcccgccccgcagtcctcattggccaattgctctctcttctacagtctcattgggaaaattatttgtctatctttacatctccccgcgctccaggaaggcgcccgcccaaccactgttattgggttcccaaccccctagtcggagtacctcattggttacatttgttgtctatcttaacggttcctcgcgccagactgtagctccgcccctcgcactctgcggtcacgtgacccaaagtgttgaggtgttgattggacaaaaagtctgccctgtaacggtacttcttgctcagtgacagcagcaacccacctccttatccctttcattggcttataaacccgtcctttaaaccactatttgggaggtcgggccatcagtttcggcgttttttccagagaggcaggctcacagcgatatcgcgagagacgggaattgctctgtcacgcaagctggagtgcagtggtgccatctcggctcactgtgacctctgcctcctgggctcaagccatcctcccacctcagcccttcaagtagctgggattacaggttgtaaaaaccccatcagggcagtgactgagtgtgtgtcactgtgtgcagcatccccagaacctaataccatgactgcatggaacaagcacccgg

SEQ ID NO: 280019 - DNA, 2278 bp, Homo sapiens
tatcggtctttccgctgctgctcccattgctgccaccagagccccctaacttcttgctccgctcaccgcgggaagtcgagtcctcaccaccacgggagcgtttggccttcactggcgagcgctcttttcccttcattgttgcgggtcgtcggaggtcgtctccgcggagctgagtaacccgccgccccgcgctcgtttcacacagcggaaccgcacgccgccatcttggactccgccgcggcacagggtcccgccccgcagtcctcattggccaattgctctctcttctacagtctcattgggaaaattatttgtctatctttacatctccccgcgctccaggaaggcgcccgcccaaccactgttattgggttcccaaccccctagtcggagtacctcattggttacatttgttgtctatcttaacggttcctcgcgccagactgtagctccgcccctcgcactctgcggtcacgtgacccaaagtgttgaggtgttgattggacaaaaagtctgccctgtaacggtacttcttgctcagtgacagcagcaacccacctccttatccctttcattggcttataaacccgtcctttaaaccactatttgggaggtcgggccatcagtttcggcgttttttccagagaggcaggctcacagcgatatcgcgagagacggtaagctccctctttcgaccccctttttccaactcctccggcggctaaaagaagtttaaatctgattggatgtcggcaaggaagttgataggctgaaataactgtccatcactcgcttaaaggggtaggcctgtataacggaggaggctgactgaaggtgaaagactagaacacgtgcttgctgtgcgacgtcacttagatgtcgcgagagggtgactgtgcgccagccccgcctccccgcgttttcggcgttctccccacaaacatttgttaagttccgtggggtgtttggctgtgcttcggcccttggagttcgaaacttctgagctccccgccgtcgtacctgtgccggccaaggggcggggcaggctttccggctgtcggggccctccagtccctcaggaagccgtcctgggacgcctagcggacaccattttacgtcgctgtggtagctgagtgaacagccggggggagccccgccccccgcgcgcgggagagcgccgcccgcggtcacctgggcccgcggggcagagagttcacggttcctgcagcctcgggtcatgctgacgcccccgggcggtgctaacacgtaacacgcgggacctcgagagctaagaagcagggcgactaagacgcagccctcgcccaggagcccgtctctcccgcgagctacccgttcccgcccaagtactccgggtaaccgaggggagtgaccgtcgctccccgcctcgtggcccgcgggcggagccggaactgtcgggacaccgcggacgtgtctttgggcggcatgttttatgttgcgaatctgtgtggatttttaaattctgtattcccctaaaatagcagtgtttttaatatgtaatgcttctaccctgaaaatcaccaagcgaaatttaggctccatgcagatatgtcacttgtttttccccctgtggcttcttgtatcccttggcactcttattgtgtgttaaaagccagcagcacaggcaccttgcggccgctccagatccacctcgtttggctccttcagtcgttcgccgtacaactttcctttccatagtgcgttactgtggcggacagagcacctgtgagaggtgcaggcgatgccgagcttaggggggtatggcctgtgccccagcactcgccggttgctggagggacgcagcgctgaggtcaccacagcctttagactgtctgcagccctcccaggttcgcgccggggcggaggttatgaggattcttgtattgatccggtcctcaaccctatttcccaagatccaatctatagtagagggtgtgaggtgtttttaaacgtgacatttttcaaggtaacaataatatcccaaaagctgaaacctaaacttaaaaactgtgttaagattagggactgtaacctaaatttagccttggctgagccatccttctttttgtaaataatcgtgaggaatgtgaagctggaggccttctatctcttgattagatcaaagaaactcgaaggaagaagctcaattgtaaagcataaaaatccacaatattgtaatgtgtagacatcttcattgtattaaaatgggaaataaaacttcataaggcataaaataatg

SEQ ID NO: 280020 - DNA, 298 bp, Homo sapiens
caacctagagactgtcactgctctttgacatattctgtcactttgcctccccaggtcaccatcctctcactcgcctctgacttttcgcacaggagagagctggtcgaatagtacaattccccgatgtgaatggggagaagctggggaaaggaagaatgatcttcaggcagtaagggtaagaggagccacttttcccatctgagtaaataccgagagaagatgaatgtgaggctcttggagattagctgtctgctgggagagaaacaccttcattgattaaatacaaaatctgttctgg

SEQ ID NO: 280021 - DNA, 476 bp, Homo sapiens
ccaggctggagtgcagtggtgagatcttggctcactgcaacctctgcctcccgggttcaagcgattctcctgcctcagcctcccgagtagctgaggcgaaaggattgcttgagcccaggaattggaggctgcagtgaggtgtcattatgcgactgcactccagcctgggtgacagagtaagaccttgtctctataagaagaagaagaaggaaggagaaggagaagaaagaggaggaggagagggagaaagcagaagaagaagaagaaggaggaagaggaggaggaggggaagaagaggaggaggaaaagaaagagagaaagaaaggaaggaaggaaggaaggaaggaaggaaggaaggaaggaaggaaggactgaccaccaccaagaagaacaagagcaggaagaggccttacagtagacggtgagggtgctgagaggcgaacggcccttgcccacactgttggtcccctggcacc

SEQ ID NO: 280022 - DNA, 2228 bp, Homo sapiens
acttccctttttccggtccgccggattatgaatgacggccggcgcgagtattttccacataagctggctgtcgtttttctcctggcctctgtggaggcgagtggtctgcgggcagcagctcccagaggcagccttggaattccagctcggactgggcgggaaggcgcaggcggcccaggtcgccgacacgctcacgcaccctccctgcctggccgcgcctctgcgaccaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcagcagtcagcccaaaggaaggtaaaatgtccagtgatcgagctttgaggaagcagcaacagttgaacaaccttgtctatgtggtaacaaatcaggccaaacctggtgacagaattgtggatttctgcagcggtggggtattttatctctcctttcatcctttttagtctttctaagattatgagacttttctatattacattcaaggtcatgtttttatttggcaagattgtggtttcagaatgaggaaaagctgtggggaccaaagctaacttgtttgtcttactgactttttcagggccatgttggaattgtccttgctcacatgctgccatcatgtcaggtaaagccagaataagagataaaaggaaatattttaaaattatacagttcagctagccaaatttggtttatcccgctcttggagtttctagtcactcacccaagtcaaatatgtggcacaggcattgtcttttctttgaaataaactttcaagactcagaatcttaaggaaaaaaaagtaaagtaagatcataaaacatttatcaatttttaaaagaggtttataggtttaagtaatttttcaaagaagtagctattttattgctaaataaaataattatgattcaactagtttaattttcaatataattttaaatggaaatattgacctctgaaacttgctgagcatattcttttggtatcttgattttgatccattgcatcaaaattataacaatagcaaaattttttaaagc

SEQ ID NO: 280023 - DNA, 1505 bp, Homo sapiens
  misc_feature (1473)..(1473): n is a, c, g, or t
  misc_feature (1495)..(1495): n is a, c, g, or t
acttccctttttccggtccgccggattatgaatgacggccggcgcgagtattttccacataagctggctgtcgtttttctcctggcctctgtggaggcgagtggtctgcgggcagcagctcccagaggcagccttggaattccagctcggactgggcgggaaggcgcaggcggcccaggtcgccgacacgctcacgcaccctccctgcctggccgcgcctctgcgaccaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcanctcgaaagcgccaagggggggntcctctagag

SEQ ID NO: 280024 - DNA, 1692 bp, Homo sapiens
acttccctttttccggtccgccggattatgaatgacggccggcgcgagtattttccacataagctggctgtcgtttttctcctggcctctgtggaggcgagtggtctgcgggcagcagctcccagaggcagccttggaattccagctcggactgggcgggaaggcgcaggcggcccaggtcgccgacacgctcacgcaccctccctgcctggccgcgcctctgcgaccaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcagcagtcagcccaaaggaaggtgagagcacacaccttgaactgagaccagcaggattcaaatcctggctccatcatggagtaactatgtgaccaaagcaagctacttcattatttttgtttacatttttcatctgataatgcaataacagtacccaacctcattgagctgttacaaaaaaggattgatataataaataaaatatgcttagcacatcgtaat

SEQ ID NO: 280025 - DNA, 1771 bp, Homo sapiens
acttccctttttccggtccgccggattatgaatgacggccggcgcgagtattttccacataagctggctgtcgtttttctcctggcctctgtggaggcgagtggtctgcgggcagcagctcccagaggcagccttggaattccagctcggactgggcgggaaggcgcaggcggcccaggtcgccgacacgctcacgcaccctccctgcctggccgcgcctctgcgaccaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcagcagtcagcccaaaggaagggtttgaacagttgaccgcatgtgattggctgaaactcggatgcaatgattggctgagacttggctacttgttataagagtgagagcacacaccttgaactgagaccagcaggattcaaatcctggctccatcatggagtaactatgtgaccaaagcaagctacttcattatttttgtttacatttttcatctgataatgcaataacagtacccaacctcattgagctgttacaaaaaaggattgatataataaataaaatatgcttagcacatcgtaat

SEQ ID NO: 280026 - DNA, 1329 bp, Homo sapiens
  misc_feature (1297)..(1297): n is a, c, g, or t
  misc_feature (1319)..(1319): n is a, c, g, or t
aacagatgattccctgattctccagagagattacacacttcgtttgtggctaaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcanctcgaaagcgccaagggggggntcctctagag

SEQ ID NO: 280027 - DNA, 250 bp, Homo sapiens
atctccagttccaagtctagatgtaatatattaagaaacagatcaactttggcagtcaagatgaaaatatactgaatcatgaatgtttgcatttggtgatcggggcttcatagagaacatattgagggattcttgtgctggcaccagctgcttaaccatcaaggattctgttatgaaatactattcctggaagaaggccttttgaggaatgaagtatatcctctttgagagtctcgccttgttgcccagg

SEQ ID NO: 280028 - DNA, 412 bp, Homo sapiens
acaagagtcttgctctgtcacccaggctggaatgcaatggtgtgaccttggctcaatgcaacctctgcctcctgggctcaagcaattctcctgcctcagcctcctgagtagctggaattacagagatggggtctagctgtgttgcccaggctgaagtccagtggcttttcacaggcacagtcataccacactgaatcttgaactcctgagatcaagcaatcctcctgcctcagcttccaaagtagctggaattacaagtgctggccactctgcctggttacaattctttttattgctgaataatattccattatgtggatatcctatactttgcttatctattcatcagttgatggacatttgggttgtttctactgtttggctattattaacactgctgtgaacatgtaca

SEQ ID NO: 280029 - DNA, 2765 bp, Homo sapiens
  misc_feature (118)..(118): n is a, c, g, or t
tgctttcccgtttcttaaacattggcgttcccaagtttctccttggtcctcctgtcatttttatctactctcgtagcttcaaataccatctagtttatagtttatttagcatgttgtncaagccaccgtcttgggcccagggctctacctgtagcttttcatccacacttctcaggttgcttcttacacagcgccatagtagttaaaatacggtctggggatagtcgtctcttcatcagtctcccccgacgacctgcgcaggcgtggcttgaggaaacgcccgctgtgggcggagccacccgaaaggctccggtcgggggcgggaacaggatcggcccgcgggctggcgtcgataggctgccgcagagacagggcgggctctgctaagggacgcgcctcgccgtggggcggtgcctgcgcctgagcctctacgagagggaaggaacgctgctccgagctccgcgtcgcgtcgcgtagattcgcgtcgccgtcgacctcagaggcggggccggaagcgctacggtttgacccccgagtccctctgttcccgaaggggcggccgtctttctcccgacccgctccgcctcctctccttcttccccattacccggaggccgaagcccccagccagggcggggcggcgcagcccgagctcccggacccggaagaagcgccatctcccgcctccaccatggagcccaccgcaccgtccctcaccgaggaggacctcactgaagtgaagaaggacgccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaaggactaaaatgtagcagttgtgaaccttttccagatggagccacgaacaacctctccagatcaaattcagatgagagtaatttctctgaaaaactgagggcatccactgtcatgtaccatccagaaggagaatccagcacgacgccctttttttctactaattcttctctgaatttgcctgttctagaagtaggcagaactgaaaataccatcttctcttcaactacacttcccagacctggggacccaggggctcctcctttgccaccagatctacagttagaagaagaaggaacttgtgcaaactctagtgagatgtttcttcccttaagatcacgtactgtttcacgacaatgacactttattgccttttaatttttaatgatgacaaaaaatgttttaaagaatatgactttttataaaatggctgtaatcatttgtttacatttgatgcatgtcttttaaaatgcaatgtaagcatactttgtaaataggatttttagaattaaaaaagcatacttctaggatagctaactgtaaatcatgttgatcatgtactttttagtaatttctttttttcctttttaaggtctttcagtacttttttaaatattttctattttaagactgattttaatagggaatatatctctatttgagaatagacccttactaggaagaacgttttttcctcagtgcatttgtgctagaaattttcaagagtctaatagtctttgccagtcattcagcagcaaattttcagcattaagctgttcctgttcagtaataaaaccggtcactgatgggaaaactgccaatatagaaaaataaaaatctcttttccactccattgtcgtataggcatgtaaacagcctctttttgatactggaggaacacttgatggagtgtgagccacctaagatctcggtttgccaaaattcatttctaattaaccttactaattatactactttgttaggattttcacattcttggcttaatcattttcattcctaaagaaaaatatcttggcctaaacctcagttattacatgtaatttgatgaggtattttttccttttttctttttttttttttttgagacagtcttgctctatcgcccaggctggagtgcagtggcgcattctaggctcactgcaacttctgcctcccatgcttacgtgatcctctcacctcagcctctcaagtaatatagctgagactacaagtgtgtgccaccatgcctcactaatttttgtattatttttgtagagacggtgttttgccatgttggccaggctggtcttgaactcctggactcaagcaacctacccagcgtggcctcccaaagtgctgggattacagacacgagccacctcacctagcctgatgagatttttaaaaaatattttctctgtacttttcattctcttttaatgaggaccaatgtacagttgaaataactggaacaaattatttttggtgtgtgtgacaattctgtttttaatgctatttgaacaagtgggccattagccagatttgtctttttgttgtaaaacaaaatttgactaattttacatgtttataaatcttatgctctcactgtttgtttttatttaaattacaattttatctgtttcctgacattgtctcctatatatttctattattaattgcaaaaacatagaaatggaaattttgctatcaacaataaaatttttttaaagta

SEQ ID NO: 280030 - DNA, 407 bp, Homo sapiens
caggtgaaagaaagaaaacccaccttctatgctgggattacagacacgagccacctcacctagcctgatgagatttttaaaaaatattttctctgtacttttcattctcttttaatgaggaccaatgtacagttgaaataactggaacaaattatttttggtgtgtgtgacaattctgtttttaatgctatttgaacaagtgggccattagccagatttgtctttttgttgtaaaacaaaatttgactaattttacatgtttataaatcttatgctctcactgtttgtttttatttaaattacaattttatctgtttcctgacattgtctcctatatatttctattattaattgcaaaaacatagaaatggaaattttgctatcaacaataaaatttttttaaagta

SEQ ID NO: 280031 - DNA, 536 bp, Homo sapiens
tgcacacgccgagtacccagacctgatggcaagtctgatggacgaagttgttgccacgccgagggaccatacctagcctgatgagatttttaaaaaatattttctctgtacttttcattctcttttaatgaggaccaatgtacagttgaaataactggaacaaattatttttggtgtgtgtgacaattctgtttttaatgctatttgaacaagtgggccattagccagatttgtctttttgttgtaaaacaaaatttgactaattttacatgtttataaatcttatgctctcactgtttgtttttatttaaattacaattttatctgtttcctgacattgtctcctatatatttctattattaattgcaaaaacatagaaatggaaattttgctatcaacaataaaatttttttaaagtagtgagtgctattttggagttccaaattttcagtaggaagtatctaaaactttttttaatacgtgccattatctatagaaaacattacttcaggttgtgagattgagttgcatttct

SEQ ID NO: 280032 - DNA, 2812 bp, Homo sapiens
tttttttttcaaaaatttgtttagtattgtagttaggctgtttgtgtgtatgcatgtgtatgtgtgtatgagtgcgtttgtgtgtgaccaaaacagtaactggcaaacgtaacaacaggaaattgtagggcagggtctgggaaaaggggaggaacccaaggtactgacaagcccagaccggactcccccgaagtgagcaggcagcaaaggctgagagtgccagctgcctgggcactgacggaccccacccacggaaacgatgccttatgaggaagctaacccgggccacttaccgacgacctgcgcaggcgtggcttgaggaaacgcccgctgtgggcggagccacccgaaaggctccggtcgggggcgggaacaggatcggcccgcgggctggcgtcgataggctgccgcagagacagggcgggctctgctaagggacgcgcctcgccgtggggcggtgcctgcgcctgagcctctacgagagggaaggaacgctgctccgagctccgcgtcgcgtcgcgtagattcgcgtcgccgtcgacctcagaggcggggccggaagcgctacggtttgacccccgagtccctctgttcccgaaggggcggccgtctttctcccgacccgctccgcctcctctccttcttccccattacccggaggccgaagcccccagccagggcggggcggcgcagcccgagctcccggacccggaagaagcgccatctcccgcctccaccatggagcccaccgcaccgtccctcaccgaggaggacctcactgaagtgaagaaggacgccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaaggactaaaatgtagcagttgtgaaccttttccagatggagccacgaacaacctctccagatcaaattcagatgagagtaatttctctgaaaaactgagggcatccactgtcatgtaccatccagaaggagaatccagcacgacgccctttttttctactaattcttctctgaatttgcctgttctagaagtaggcagaactgaaaataccatcttctcttcaactacacttcccagacctggggacccaggggctcctcctttgccaccagatctacagttagaagaagaaggaacttgtgcaaactctagtgagatgtttcttcccttaagatcacgtactgtttcacgacaatgacactttattgccttttaatttttaatgatgacaaaaaatgttttaaagaatatgactttttataaaatggctgtaatcatttgtttacatttgatgcatgtcttttaaaatgcaatgtaagcatactttgtaaataggatttttagaattaaaaaagcatacttctaggatagctaactgtaaatcatgttgatcatgtactttttagtaatttctttttttcctttttaaggtctttcagtacttttttaaatattttctattttaagactgattttaatagggaatatatctctatttgagaatagacccttactaggaagaacgttttttcctcagtgcatttgtgctagaaattttcaagagtctaatagtctttgccagtcattcagcagcaaattttcagcattaagctgttcctgttcagtaataaaaccggtcactgatgggaaaactgccaatatagaaaaataaaaatctcttttccactccattgtcgtataggcatgtaaacagcctctttttgatactggaggaacacttgatggagtgtgagccacctaagatctcggtttgccaaaattcatttctaattaaccttactaattatactactttgttaggattttcacattcttggcttaatcattttcattcctaaagaaaaatatcttggcctaaacctcagttattacatgtaatttgatgaggtattttttccttttttctttttttttttttttgagacagtcttgctctatcgcccaggctggagtgcagtggcgcattctaggctcactgcaacttctgcctcccatgcttacgtgatcctctcacctcagcctctcaagtaatatagctgagactacaagtgtgtgccaccatgcctcactaatttttgtattatttttgtagagacggtgttttgccatgttggccaggctggtcttgaactcctggactcaagcaacctacccagcgtggcctcccaaagtgctgggattacagacacgagccacctcacctagcctgatgagatttttaaaaaatattttctctgtacttttcattctcttttaatgaggaccaatgtacagttgaaataactggaacaaattatttttggtgtgtgtgacaattctgtttttaatgctatttgaacaagtgggccattagccagatttgtctttttgttgtaaaacaaaatttgactaattttacatgtttataaatcttatgctctcactgtttgtttttatttaaattacaattttatctgtttcctgacattgtctcctatatatttctattattaattgcaaaaacatagaaatggaaattttgctatcaacaataaaatttttttaaagta

SEQ ID NO: 280033 - DNA, 1893 bp, Homo sapiens
tttttttttcaaaaatttgtttagtattgtagttaggctgtttgtgtgtatgcatgtgtatgtgtgtatgagtgcgtttgtgtgtgaccaaaacagtaactggcaaacgtaacaacaggaaattgtagggcagggtctgggaaaaggggaggaacccaaggtactgacaagcccagaccggactcccccgaagtgagcaggcagcaaaggctgagagtgccagctgcctgggcactgacggaccccacccacggaaacgatgccttatgaggaagctaacccgggccacttaccgacgacctgcgcaggcgtggcttgaggaaacgcccgctgtgggcggagccacccgaaaggctccggtcgggggcgggaacaggatcggcccgcgggctggcgtcgataggctgccgcagagacagggcgggctctgctaagggacgcgcctcgccgtggggcggtgcctgcgcctgagcctctacgagagggaaggaacgctgctccgagctccgcgtcgcgtcgcgtagattcgcgtcgccgtcgacctcagaggcggggccggaagcgctacggtttgacccccgagtccctctgttcccgaaggggcggccgtctttctcccgacccgctccgcctcctctccttcttccccattacccggaggccgaagcccccagccagggcggggcggcgcagcccgagctcccggacccggaagaagcgccatctcccgcctccaccatggagcccaccgcaccgtccctcaccgaggaggacctcactgaagtgaagaaggacgccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaaggactaaaatgtagcagttgtgaaccttttccagatggagccacgaacaacctctccagatcaaattcagatgagagtaatttctctgaaaaactgagggcatccactgtcatgtaccatccagaaggagaatccagcacgacgccctttttttctactaattcttctctgaatttgcctgttctagaagtaggcagaactgaaaataccatcttctcttcaactacacttcccagacctggggacccaggggctcctcctttgccaccagatctacagttagaagaagaaggaacttgtgcaaactctagtgagatgtttcttcccttaagatcacgtactgtttcacgacaatgacactttattgccttttaatttttaatgatgacaaaaaatgttttaaagaatatgactttttataaaatggctgtaatcatttgtttacatttgatgcatgtcttttaaaatgcaatgtaagcatactttgtaaataggatttttagaattaaaaaagcatacttctaggatagctaactgtaaatcatgttgatcatgtactttttagtaatttctttttttcctttttaaggtctttcagtacttttttaaatattttctattttaagactgattttaatagggaatatatctctatttgagaatagacccttactaggaagaacgttttttcctcagtgcatttgtgctagaaattttcaaaatcctgtctgtcctatcaacacgacccaagtttgattcatagcatcatacttcctttgtacaaaccatgtttgtagtacatataatgtt

SEQ ID NO: 280034 - DNA, 450 bp, Homo sapiens
cccgctcggcgtaacgcactacagcccagaactcctggactcaagcaacctacccagcgtggcctcccaaagtgctgggattacagacacgagccacctcacctagcctgatgagatttttaaaaaatattttctctgtacttttcattctcttttaatgaggaccaatgtacagttgaaataactggaacaaattatttttggtgtgtgtgacaattctgtttttaatgctatttgaacaagtgggccattagccagatttgtctttttgttgtaaaacaaaatttgactaattttacatgtttataaatcttatgctctcactgtttgtttttatttaaattacaattttatctgtttcctgacattgtctcctatatatttctattattaattgcaaaaacatagaaatggaaattttgctatcaacaataaaatttttttaaagta

SEQ ID NO: 280035 - DNA, 453 bp, Homo sapiens
gccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaaggtaagatatcttaattatctaagagctaatttaaatgtaataatgcttttaaaaaatgcagagcaggccaggtgcctgcactttaggaggccaaggcaggaggattgcttgaggtcaggagttttgagaccagcctgggcaacatagcgagactttgtctctac

SEQ ID NO: 280036 - DNA, 2881 bp, Homo sapiens
  misc_feature (118)..(118): n is a, c, g, or t
tgctttcccgtttcttaaacattggcgttcccaagtttctccttggtcctcctgtcatttttatctactctcgtagcttcaaataccatctagtttatagtttatttagcatgttgtncaagccaccgtcttgggcccagggctctacctgtagcttttcatccacacttctcaggttgcttcttacacagcgccatagtagttaaaatacggtctggggatagtcgtctcttcatcagtctcccccgacgacctgcgcaggcgtggcttgaggaaacgcccgctgtgggcggagccacccgaaaggctccggtcgggggcgggaacaggatcggcccgcgggctggcgtcgataggctgccgcagagacagggcgggctctgctaagggacgcgcctcgccgtggggcggtgcctgcgcctgagcctctacgagagggaaggaacgctgctccgagctccgcgtcgcgtcgcgtagattcgcgtcgccgtcgacctcagaggcggggccggaagcgctacggtttgacccccgagtccctctgttcccgaaggggcggccgtctttctcccgacccgctccgcctcctctccttcttccccattacccggaggccgaagcccccagccagggcggggcggcgcagcccgagctcccggacccggaagaagcgccatctcccgcctccaccatggagcccaccgcaccgtccctcaccgaggaggacctcactgaagtgaagaaggacgccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaaggactaaaatgtagcagttgtgaaccttttccagatggagccacgaacaacctctccagatcaaattcagatgagagtaatttctctgaaaaactgagggcatccactgtcatgtaccatccagaaggagaatccagcacgacgccctttttttctactaattcttctctgaatttgcctgttctagaagtaggcagaactgaaaataccatcttctcttcaactacacttcccagacctggggacccaggggctcctcctttgccaccagatctacagttagaagaagaaggaacttgtgcaaactctagtgagatgtttcttcccttaagatcacgtactgtttcacgacaatgacactttattgccttttaatttttaatgatgacaaaaaatgttttaaagaatatgactttttataaaatggctgtaatcatttgtttacatttgatgcatgtcttttaaaatgcaatgtaagcatactttgtaaataggatttttagaattaaaaaagcatacttctaggatagctaactgtaaatcatgttgatcatgtactttttagtaatttctttttttcctttttaaggtctttcagtacttttttaaatattttctattttaagactgattttaatagggaatatatctctatttgagaatagacccttactaggaagaacgttttttcctcagtgcatttgtgctagaaattttcaagagtctaatagtctttgccagtcattcagcagcaaattttcagcattaagctgttcctgttcagtaataaaaccggtcactgatgggaaaactgccaatatagaaaaataaaaatctcttttccactccattgtcgtataggcatgtaaacagcctctttttgatactggaggaacacttgatggagtgtgagccacctaagatctcggtttgccaaaattcatttctaattaaccttactaattatactactttgttaggattttcacattcttggcttaatcattttcattcctaaagaaaaatatcttggcctaaacctcagttattacatgtaatttgatgaggtattttttccttttttctttttttttttttttgagacagtcttgctctatcgcccaggctggagtgcagtggcgcattctaggctcactgcaacttctgcctcccatgcttacgtgatcctctcacctcagcctctcaagtaatatagctgagactacaagtgtgtgccaccatgcctcactaatttttgtattatttttgtagagacggtgttttgccatgttggccaggctggtcttgaactcctggactcaagcaacctacccagcgtggcctcccaaagtgctgggattacagacacgagccacctcacctagcctgatgagatttttaaaaaatattttctctgtacttttcattctcttttaatgaggaccaatgtacagttgaaataactggaacaaattatttttggtgtgtgtgacaattctgtttttaatgctatttgaacaagtgggccattagccagatttgtctttttgttgtaaaacaaaatttgactaattttacatgtttataaatcttatgctctcactgtttgtttttatttaaattacaattttatctgtttcctgacattgtctcctatatatttctattattaattgcaaaaacatagaaatggaaattttgctatcaacaataaaatttttttaaagtagtgagtgctattttggagttccaaattttcagtaggaagtatctaaaactttttttaatacgtgccattatctatagaaaacattacttcaggttgtgagattgagttgcatttct

SEQ ID NO: 280037 - DNA, 435 bp, Homo sapiens
aagcccccagccagggcggggcggcgcagcccgagctcccggacccggaagaagcgccatctcccgcctccaccatggagcccaccgcaccgtccctcaccgaggaggacctcactgaagtgaagaaggacgtgagtaacgcagctgtgcccagggcgggcgggggcgggctgcagcccagcgggagacgaaagcggaagcctggagtccgaggacaaggaggatcctccaggtcggaggagcggaaagtcctagcacaggaggactgtggcgagccctgcatccgagggaccttggtggcagtgatcctccagtgatctgtcaatccaggttttacatcgctaaacgcagagcttgggctttgttgccaagtggtgttttgattcttgcccactcctcacccatctcctcatgctttccccccaactgggttct

SEQ ID NO: 280038 - DNA, 551 bp, Homo sapiens
tgcccccgcggggtctgtgtccccgggaggagttggctgcgtttggagatccctcggcctgagagcaccagattctcaaaacagtaagtcctaccacttgttctatcgtaaaacttattttgggcaagtcactcaagccttcgataggtaagatagtacctgaaagcattccagctcaactctgccccaagagggagccaccccatggaaggacggagctgagcaacatgccactcaaaggaaaagcacttagaaccactctaatgcagactttggagccacatgtgggtttgaatctcaactctacctgagtgaccctgggcaagtcacttcacttccctgagactcaagtttcatcaagatgggaacaatgagcatctgcctcacaggcttgtcgtgaggattaagtgagaaggtgcagctgcaaagacatcaagctggacccatcgaggatttcggattcagccatcatggggctgctgccggggaagccactgcccctcctttctcctcagcactggggttataaaaaaatacctacaaaccaaaaa

SEQ ID NO: 280039 - DNA, 439 bp, Homo sapiens
tgcccccgcggggtctgtgtccccgggaggagttggctgcgtttggagatccctcggcctggtattcgtcgcgtctccctgcttgttgctctccacgtttagccccatccgacttctggaagcccagggagagcaccagattctcaaaacaatgcagactttggagccacatgtgggtttgaatctcaactctacctgagtgaccctgggcaagtcacttcacttccctgagactcaagtttcatcaagatgggaacaatgagcatctgcctcacaggcttgtcgtgaggattaagtgagaaggtgcagctgcaaagacatcaagctggacccatcgaggatttcggattcagccatcatggggctgctgccggggaagccactgcccctcctttctcctcagcactggggttataaaaaaatacctacaaaccaaaaa

SEQ ID NO: 280040 - DNA, 442 bp, Homo sapiens
cccatctggtctggaggtcagaggggagtgagacactctggtttgaaaggccttcctttccactttggggaaaacaggcagggagagaggtgagggtgccatgccaaaaaacacccccaaatccagatgcagactttggagccacatgtgggtttgaatctcaactctacctgagtgaccctgggcaagtcacttcacttccctgagactcaagtttcatcaagatgggaacaatgagcatctgcctcacaggcttgtcgtgaggattaagtgagaaggtgcgtgtaatattagcgatgactggatgatacaaaattaagaacaaggctgggcacgattgctcacgcctgtaatcccagcactttgggaggctgaggcaggtggatcacctgaggtcagaagttccagatcagcctgaccaatatggtgaaaccccatctct

SEQ ID NO: 280041 - DNA, 347 bp, Homo sapiens
gagtgaactggattggattagccgctggtcttgtccttaaataatacatcccagtcttcaaaccctacaaggaaagtaaagacaattattaggagaaactctgtgagaatactagacattccacaccaatatttaaaatacattcctgtccagccgccccgtccaggagggaggtgtgcccaacagctcattgagaacgggccaagatgacaatggcggctttgtggaatagaagggcgggaaaggtggggaaaagattgagaaatcggatggttgccgtgtctgtgtagaaagaagtagacacgggagacttttcattttgttctgtactaagaaaaattcttctg

SEQ ID NO: 280042 - DNA, 286 bp, Homo sapiens
tattccccagcaaagatgtgaaacctaaacgcctaaccttttctgcctggtggactgccctctactggactatttgaggtattcagccagcaggtcaatgtgactaaaaaggcagatttggataacagattataagaacaatgtagaagaaatcaaatgtagataaagaaaaagccttactttatgagaatcatgaagatgactttgaaatgtaatttattccttggttcttcaatcattgtataatttattaatatctttctatgatcaagatgttagataacag

SEQ ID NO: 280043 - DNA, 939 bp, Homo sapiens
tattccccagcaaagatgtgaaacctaaacgcctaaccttttctgcctggtggactgccctctactggactatttgaggtattcagccagcaggtcaatgtgactaaaaaggtaaacatagagataaatgtaaacattaaaaaaaaaggaaccctttagtatattaacttttaccatgaaaacaatttcagtcattttgagaactgacaatgaagatgtttatacagtcttagtctccttttcaaccttggaggcagatctgcagcaataatagtaacaagtaggagcaatgggtgtactatcatgaccatcttttatgatgactggtgcattaatacaaatcacatttttctgagtccattcatgctatggatgttttcttatgcataaacatagagtagacacatactaaatagatcacatctgttaagtctcttgccacaagcatcaaaacttttcagagctgtctcttccgtgaaaatccatttcatgtagtagcaagttgattttctttgtggttcatccccacgcctgagacttgcagtaatgtaaaaccagtttaccatcactgccaaaacactcatagagagttccaacttcttggtctggggaaggagcaaaggactgattcacataaataaacaactgttctgaggccacaagtttaagaaactttttgatgaagtcaatgagtccttggatggttcgtgttcgctctactgcccacttctttgttttcataataggagtgtctcccacagcctttagcaaaatgtcaacttttttttcttggtgtcgccagcaggttcctctgttcccggggaaactgcagcggaagacgggggctccggggtggttgtttctggggagacatccgtaagtccttcccctccagcagcaattgaagtaggaagctgcaacacagactgcggctcctcc

SEQ ID NO: 280044 - DNA, 348 bp, Homo sapiens
catagagagttccaacttcttggtctggggaaggagcaaaggactgattcacataaataaactacaagaaaggaaggaaaaacagagatgtttaatggtatcctgattaatctgcatttttctgcattccaatcagctagctattttgtattgttttcacaattgaagaaagcttctctgaactcctaacttttctaaatagtcaatttaaagagatcattacgaagatctcatttttcctccagaggaataaaaataacacaattccagttcctagaacagtggttcctaactttgtataactaagaaacttttaaatattttttacaaatagcttttgaagagctg

SEQ ID NO: 280045 - DNA, 551 bp, Homo sapiens
attttgaaaccacgtacctcagtataaacagccatagggaaagtgtttcaagacatttatcattctaatacttagcatgcacaagatctgctcatttattatactgtagccagtgtaagttgtaagttattatagattatgcatttctacctatattgtagacagtgcatactatggagtatgcattttgtctttgaggtttttgtaagcattattggttactattgtcagcaaaggggttatattaataaaaaggtaggaaaccagatatggcgatttagcattgagctactagatttccccacatgcataaagcaatttaattgcaagatagtagagctgtcatagctttaatcttttgtgagatggcctctgctttggttccaggttctgtgtaaaatgaaagatgtacttttgtttttgatgaaaaaaagcagaaatgatcattcatttagtgctaaccaactagtttagtaatccagtgaagctagatgtcaaaaaattttattttatatttgtcttgtcaaatactgaattaccgtataacttta

SEQ ID NO: 280046 - DNA, 2116 bp, Homo sapiens
agcccttccctcccaggcctgcttggaggtcgggcctcagctcccgaagaacattgagaatggcccccaagtctggccaggaggttgaagaaaccgaggaagaggctctcctgtcccccacagagcaagagtcggtcagtggtcacctgggacctccagcaggcgcacctgcagcccccgagactcccacgtgcctgccagacaccacgccccaccccacaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaggagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcagcagccccggccctggccacagctggacacagggagcccagagtcctctggaaagcattccgagcggcatcacaagaccgtggagtggggctccctgccctgtctgaacaccagcagctcagggggcgctgactccgactccagcagctgccggccgggcctgccttccttcgtgcaggtgatagggcacccgccccgggaccaccgcgcttcctccgagcaagcgctggtgcaggccgggagctacagcagggactcagaagatctccagaaaacccactcacccaggcacggcgagccggtcctgtcgccccagccctgcacagacccggaccactggagcccggaactcctgcagagcccgacaggcctgaagatcgtggctgtgagctgccgggagaagttcgtccgcatcttcaacccgtcgcaggagagcacggccgacctgagcggcatggtgctgaagcagctggtgcgcggcttcccggagcgcctgtaccgcttcccgccgggcacgctgctggccccgcggcaccacgtcacggtctggggcgaggcgacccgcagcgccaagaagccgctgcgcgcgtcctcgagccgggagcccgttcccctcctctccatccgcggctgcgcgacgctgctcctgagccccaagggcgaggtcctcagtgagcaccggatcccacgccgcgagactccggccccgagggtcttcgccgacggcaccgacttgtccatcgaccgcttcccgctccctgaggccgggcccggcgccgacacccgcaagccgccgcgcccacctcgacccctgcgcaaaggccgggtgcgggagccccgggtcagtcgccggagaccagggacgcggggcctgctgcccccagtgagctcggggaagctcttccacgcgcgggaggggcctgcgcggcccgagaaccccgagatccccgcgccgcagcacctgcccgccatcccgggtgaccccaccctgccgtcgcctcccgcagaggccgggctgggcctggaggactgtcggctccagaaagaacaccgagttcgggtgtgccggaagagcgtggaccgtagctgccccctggtggccctgtcggtgcagaacacggcggagagcagattcggcttccgcttcctcagctgcctgccggtcaccgcggacacctgccgcggcgcctaggggcggaggagtggggccgggaccgcgagggagggcgcgggcgggcgccggggctgggcgggctgtgtccgctgcatcatttattgaaccaacgtggcctacaaagtaaaccgcatttctgtaca

SEQ ID NO: 280047 - DNA, 2567 bp, Homo sapiens
agcccttccctcccaggcctgcttggaggtcgggcctcagctcccgaagaacattgagaatggcccccaagtctggccaggaggttgaagaaaccgaggaagaggctctcctgtcccccacagagcaagagtcggtcagtggtcacctgggacctccagcaggcgcacctgcagcccccgagactcccacgtgcctgccagacaccacgccccaccccacaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaggagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcagcagccccggccctggccacagctggacacagggagcccagagtcctctggaaagcattccgagcggcatcacaagaccgtggagtggggctccctgccctgtctgaacaccagcagctcagggggcgctgactccgactccagcagctgccggccgggcctgccttccttcgtgcaggtgatagggcacccgccccgggaccaccgcgcttcctccgagcaagcgctggtgcaggccgggagctacagcagggactcagaagatctccagaaaacccactcacccaggcacggcgagccggtcctgtcgccccagccctgcacagacccggaccactggagcccggaactcctgcagagcccgacaggcctgaagatcgtggctgtgagctgccgggagaagttcgtccgcatcttcaacccgtcgcaggagagcacggccgacctgagcggcatggtgctgaagcagctggtgcgcggcttcccggagcgcctgtaccgcttcccgccgggcacgctgctggccccgcggcaccacgtcacggtctggggcgaggcgacccgcagcgccaagaagccgctgcgcgcgtcctcgagccgggagcccgttcccctcctctccatccgcggctgcgcgacgctgctcctgagccccaagggcgaggtcctcagtgagcaccggatcccacgccgcgagactccggccccgagggtcttcgccgacggcaccgacttgtccatcgaccgcttcccgctccctgaggccgggcccggcgccgacacccgcaagccgccgcgcccacctcgacccctgcgcaaaggccgggtgcgggagccccgggtcagtcgccggagaccagggacgcggggcctgctgcccccagtgagctcggggaagctcttccacgcgcgggaggggcctgcgcggcccgagaaccccgagatccccgcgccgcagcacctgcccgccatcccgggtgaccccaccctgccgtcgcctcccgcagaggccgggctgggcctggaggactgtcggctccagaaagaacaccgagttcgggtgtgccggaagagcgtggaccgtagctgccccctggtggccctgtcggtgcagaacacggcggagagcagattcggcttccgcttcctcagctgcctgccggtcaccgcggacacctgccgcggcgcctaggggcggaggagtggggccgggaccgcgagggagggcgcgggcgggcgccggggctgggcgggctgtgtccgctgcatcatttattgaaccaacgtggcctacaaagtaaaccgcatttctgtacacctgagagctggaaatgttggtttgggttccggggcgtcctgcgccaagaggagggaacgggccgccctatcgcagtgcgggaaccctacagatcccccggagacgggaggcctggaccgcacccccggcggcctcaggcgagcagctgggaccttgggccactgcggcctaggaggtggctcttaccctggggccggcaagggagtggtggactcgcagctccagcccctgcccctcggccatgcccaattctagcaggagaggcctctcacaggcctgctcgggtgaccaccccccacccccgtgcccgcgggaaagcctggccctaaggaagggctggggagccggaccctccctccccaggccaacccagttgggggcctaaactgggttccagcctctgctgcctccctggctggtcccagtcccccactcccctccaccaagagg

SEQ ID NO: 280048 - DNA, 1010 bp, Homo sapiens
agctgtgcgggtggaccggccgcatctcctcacagcgtctcctctcttcccagcccgacaggcctgaagatcgtggctgtgagctgccgggagaagttcgtccgcatcttcaacccgtcgcaggagagcacggccgacctgagcggcatggtgctgaagcagctggtgcgcggcttcccggagcgcctgtaccgcttcccgccgggcacgctgctggccccgcggcaccacgtcacggtctggggcgaggcgacccgcagcgccaagaagccgctgcgcgcgtcctcgagccgggagcccgttcccctcctctccatccgcggctgcgcgacgctgctcctgagccccaagggcgaggtcctcagtgagcaccggatcccacgccgcgagactccggccccgagggtcttcgccgacggcaccgacttgtccatcgaccgcttcccgctccctgaggccgggcccggcgccgacacccgcaagccgccgcgcccacctcgacccctgcgcaaaggccgggtgcgggagccccgggtcagtcgccggagaccagggacgcggggcctgctgcccccagtgagctcggggaagctcttccacgcgcgggaggggcctgcgcggcccgagaaccccgagatccccgcgccgcagcacctgcccgccatcccgggtgaccccaccctgccgtcgcctcccgcagaggccgggctgggcctggaggactgtcggctccagaaagaacaccgagttcgggtgtgccggaagagcgtggaccgtagctgccccctggtggccctgtcggtgcagaacacggcggagagcagattcggcttccgcttcctcagctgcctgccggtcaccgcggacacctgccgcggcgcctaggggcggaggagtggggccgggaccgcgagggagggcgcgggcgggcgccggggctgggcgggctgtgtccgctgcatcatttattgaaccaacgtggcctacaaagtaaaccgcatttctgtaca

SEQ ID NO: 280049 - DNA, 1030 bp, Homo sapiens
cggaggggggcgccgagccgcagtccccgcccccacctcccgcctaccgcgaaaaacgcggaaatgcggtggctgcggcccgcgggcaggcgtcgggagcaagagtcggtcagtggtcacctgggacctccagcaggcgcacctgcagcccccgagactcccacgtgcctgccagacaccacgccccaccccacaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaggagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcagtgtgccggaagagcgtggaccgtagctgccccctggtggccctgtcggtgcagaacacggcggagagcagattcggcttccgcttcctcagctgcctgccggtcaccgcggacacctgccgcggcgcctaggggcggaggagtggggccgggaccgcgagggagggcgcgggcgggcgccggggctgggcgggctgtgtccgctgcatcatttattgaaccaacgtggcctacaaagtaaaccgcatttctgtaca

SEQ ID NO: 280050 - DNA, 493 bp, Homo sapiens
atgcgcgttctctgatctgtagaatgcgttggggttgaggcagccatcactgtcctgccatgaactgagcctgggtactgggaggcaagaggggctccctgctgcactgccttgtgaggctggacgggggcagggctggggtctggagctggagtggccatcaagcagagcgtggtccacaggcagccccggccctggccacagctggacacagggagcccagagtcctctggaaagcattccgagcggcatcacaagaccgtggagtggggctccctgccctgtctgaacaccagcagctcagggggcgctgactccgactccagcagctgccggccgggcctgccttccttcgtgcaggtgatagggcacccgccccgggaccaccgcgcttcctccgagcaagcgctggtgcaggccgggagctacagcagggactcagaaggtgcagtggggcgggtctcccctggttacccttcacccaccctccacc

SEQ ID NO: 280051 - DNA, 330 bp, Homo sapiens
tctctcccctcccctcccctcccgtccccgccccgccccgcgcgcctctcagcccccgcgccccccaggtgtgccggaagagcgtggaccgtagctgccccctggtggccctgtcggtgcagaacacggcggagagcagattcggcttccgcttcctcagctgcctgccggtcaccgcggacacctgccgcggcgcctaggggcggaggagtggggccgggaccgcgagggagggcgcgggcgggcgccggggctgggcgggctgtgtccgctgcatcatttattgaaccaacgtggcctacaaagtaaaccgcatttctgtacacctga

SEQ ID NO: 280052 - DNA, 2090 bp, Homo sapiens
cggaggggggcgccgagccgcagtccccgcccccacctcccgcctaccgcgaaaaacgcggaaatgcggtggctgcggcccgcgggcaggcgtcgggagcaagagtcggtcagtggtcacctgggacctccagcaggcgcacctgcagcccccgagactcccacgtgcctgccagacaccacgccccaccccacaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaggagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcagcagccccggccctggccacagctggacacagggagcccagagtcctctggaaagcattccgagcggcatcacaagaccgtggagtggggctccctgccctgtctgaacaccagcagctcagggggcgctgactccgactccagcagctgccggccgggcctgccttccttcgtgcaggtgatagggcacccgccccgggaccaccgcgcttcctccgagcaagcgctggtgcaggccgggagctacagcagggactcagaagatctccagaaaacccactcacccaggcacggcgagccggtcctgtcgccccagccctgcacagacccggaccactggagcccggaactcctgcagagcccgacaggcctgaagatcgtggctgtgagctgccgggagaagttcgtccgcatcttcaacccgtcgcaggagagcacggccgacctgagcggcatggtgctgaagcagctggtgcgcggcttcccggagcgcctgtaccgcttcccgccgggcacgctgctggccccgcggcaccacgtcacggtctggggcgaggcgacccgcagcgccaagaagccgctgcgcgcgtcctcgagccgggagcccgttcccctcctctccatccgcggctgcgcgacgctgctcctgagccccaagggcgaggtcctcagtgagcaccggatcccacgccgcgagactccggccccgagggtcttcgccgacggcaccgacttgtccatcgaccgcttcccgctccctgaggccgggcccggcgccgacacccgcaagccgccgcgcccacctcgacccctgcgcaaaggccgggtgcgggagccccgggtcagtcgccggagaccagggacgcggggcctgctgcccccagtgagctcggggaagctcttccacgcgcgggaggggcctgcgcggcccgagaaccccgagatccccgcgccgcagcacctgcccgccatcccgggtgaccccaccctgccgtcgcctcccgcagaggccgggctgggcctggaggactgtcggctccagaaagaacaccgagttcgggtgtgccggaagagcgtggaccgtagctgccccctggtggccctgtcggtgcagaacacggcggagagcagattcggcttccgcttcctcagctgcctgccggtcaccgcggacacctgccgcggcgcctaggggcggaggagtggggccgggaccgcgagggagggcgcgggcgggcgccggggctgggcgggctgtgtccgctgcatcatttattgaaccaacgtggcctacaaagtaaaccgcatttctgtaca

SEQ ID NO: 280053 - DNA, 2586 bp, Homo sapiens
agcccttccctcccaggcctgcttggaggtcgggcctcagctcccgaagaacattgagaatggcccccaagtctggccaggaggttgaagaaaccgaggaagaggctctcctgtcccccacagagcaagagtcggtcagtggtcacctgggacctccagcaggcgcacctgcagcccccgagactcccacgtgcctgccagacaccacgccccaccccacaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaggagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcagcagccccggccctggccacagctggacacagggagcccagagtcctctggaaagcattccgagcggcatcacaagaccgtggagtggggctccctgccctgtctgaacaccagcagctcagggggcgctgactccgactccagcagctgccggccgggcctgccttccttcgtgcaggtgatagggcacccgccccgggaccaccgcgcttcctccgagcaagcgctggtgcaggccgggagctacagcagggactcagaagatctccagaaaacccactcacccaggcacggcgagccggtcctgtcgccccagccctgcacagacccggaccactggagcccggaactcctgcagagcccgacaggcctgaagatcgtggctgtgagctgccgggagaagttcgtccgcatcttcaacccgtcgcaggagagcacggccgacctgagcggcatggtgctgaagcagctggtgcgcggcttcccggagcgcctgtaccgcttcccgccgggcacgctgctggccccgcggcaccacgtcacggtctggggcgaggcgacccgcagcgccaagaagccgctgcgcgcgtcctcgagccgggagcccgttcccctcctctccatccgcggctgcgcgacgctgctcctgagccccaagggcgaggtcctcagtgagcaccggatcccacgccgcgagactccggccccgagggtcttcgccgacggcaccgacttgtccatcgaccgcttcccgctccctgaggccgggcccggcgccgacacccgcaagccgccgcgcccacctcgacccctgcgcaaaggccgggtgcgggagccccgggtcagtcgccggagaccagggacgcggggcctgctgcccccagtgagctcggggaagctcttccacgcgcgggaggggcctgcgcggcccgagaaccccgagatccccgcgccgcagcacctgcccgccatcccgggtgaccccaccctgccgtcgcctcccgcagaggccgggctgggcctggaggactgtcggctccagaaagaacaccgagttcgggtgtgccggaagagcgtggaccgtagctgccccctggtggccctgtcggtgcagaacacggcggagagcagattcggcttccgcttcctcagctgcctgccggtcaccgcggacacctgccgcggcgcctaggggcggaggagtggggccgggaccgcgagggagggcgcgggcgggcgccggggctgggcgggctgtgtccgctgcatcatttattgaaccaacgtggcctacaaagtaaaccgcatttctgtacaaaaaaaaaaaaaaaaaaaaaaaaaaaaaaaaaaaaagaaaataaaaaaaaaaaaaaaaaaagggggggagggaaaagataattcaagcgggggaaaagagagggataacacatttatttgaaaaaggacgagtgcccactatatgagacgagttatatattaataacaagaagcaagagtggcggaagtttttaaaaaaggaggtaagaacagtgaaaaaaatattggctacctgaggagaatcatagtggaaagagacacccaatagatgggggaggaggaagaaataaagtggggagaaaactaaccaaagaagaagatataaaaaggcagtaaaaagggaagaaattataaagcatattagagaggggtataaagtgtggtaaaaataaacaacgtgaaaagttagataagagagagaaatattgtaataaagaagagaagtttcagtaggaaaaatttttcccagg

SEQ ID NO: 280054 - DNA, 341 bp, Homo sapiens
ctggcttccggtcccctcttgcaggtagtgacggcagagactctgatggacccaagcgacctctctgaaaacattcaggcccccaccggggaggtgagctaggcctcccacgtgtgtggtctggtatctggagccctgcgggaggggaggaccatgtgcctcttgcttcctggccagggctttcggctggaggacgtggattggaacagcgttgcccgccggtatcccaacctcttcaccaacatggagcccagctcaaagcaaaaagtaactgcacagagcagggactccccaggggccagaagggagggctcaccttggcaagtgaagacgcaggacac

SEQ ID NO: 280055 - DNA, 1861 bp, Homo sapiens
gcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtttaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaata

SEQ ID NO: 280056 - DNA, 2239 bp, Homo sapiens
  misc_feature (1004)..(1004): n is a, c, g, or t
  misc_feature (1254)..(1254): n is a, c, g, or t
gcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgtgctggattaaaaaaggaggatgaggcccgtcccgtgaggtctgcgtccatgagggttagaggtgggttaggggcatgggggcaccagcaaggggagggttgtatggagtgggagagccagggggcaggtagtgggtataggtgggcagcagttccccctggagcctagggtcactctgagggagggagcacggtgagggggcttccagtttgcagtgggaagagctgcagagagaaacaagaggttagagggcacttccctgggttggaggtgagtctggccagttctgggcagacagggtagagcgtgccacccacccagccctggctacccagccngctgggcgcagcaggcatggaagccgaccccgggatggagagcccgcggccctgttggggcacgctcgggagcgggcttgcgtgctgcacggctgttttcctcttggggagtcaggccaggaaagggcagaatgagctcggcctctccttgccctgggggctgggagaggaagctgggtcacacacaggccagaagcaggggggaaacggggcatctaactaggacacagtcgcatccaggggtcagtcncctgaccctacagggcccaccaccttcagactgagatggaaacgccctctgggagaaccctgatccgccccaccctacacaggccccggaggtactgggcctgcgcccgccacaccttggccgcgagtggcctctgcttgggtgggctcccgtcctccggcatccgcccccaccaaggctccagaagaggggcgcatgggcctccgtcttcggcccgcttcccaggcactcacccatagctgccaggcaggtaggctgtcgagtagctggggggtctgtacccaaagcctctgctcggttgggtggtcgcgtaccccggcccccagagcgggccgccgctggccaggttgcctcttccctgtccgcagcgggaagtccggcgcccgagctcttggccttgcgccgaggccggtacttgtagtcggggtagtcgcgcaggtgtcgggcgcggagccgcttggcctcctccacgaaggccgcttctcgtcctcgtccagcagcttccactgcgcgcccaggcgcttggagatctcggagttgtgcatcttggggttctgctgcgccatctggcggcgctgagcggagctccacaccatgaacgcgttcatcggccgcttcaccttctccaggggcagccatcccggaccaccaccccaacccctttcctggtgcctgttgctcctcaaatcccagaactgcccctggggcaagaaaggccgaggagggagaccatttttgtttcctgagtcattcccagaagtaagaccatctttgggacaagagacaatgaagagaagtcagatgtggaggaacagaaaacaagagccaggggccagggcaggtcagtcctagagaaacaaatggaccaaactggggacaaagaaggcacaggagccagacagccatttggatttttttattctctttttaaatactgtacagtgaaaaataaatacgccttctcatccaccagacaaggttggtc

SEQ ID NO: 280057 - DNA, 334 bp, Homo sapiens
cagcaaacttgggggaggggagaagcaacaaggcacaagcccccctcctctgaaccaggagggagaacctgggcctggggagtttaggaatgtcaggaattcccagaagtaagaccatctttgggacaagagacaatgaagagaagtcagatgtggaggaacagaaaacaagagccaggggccagggcaggtcagtcctagagaaacaaatggaccaaactggggacaaagaaggcacaggagccagacagccatttggatttttttattctctttttaaatactgtacagtgaaaaataaatacgccttctcatccaccagacaaggttggtc

SEQ ID NO: 280058 - DNA, 431 bp, Homo sapiens
cctggagccagaacagaacaccaccaagaaggccggaccccgggctccagaggctgctgtgagggaaccctgctccccactctgcccaacggcccagcccaagccccaggcctcaggtaatcggattaagcacaagcccccctcctctgaaccaggagggagaacctgggcctggggagtttaggaatgtcaggaattcccagaagtaagaccatctttgggacaagagacaatgaagagaagtcagatgtggaggaacagaaaacaagagccaggggccagggcaggtcagtcctagagaaacaaatggaccaaactggggacaaagaaggcacaggagccagacagccatttggatttttttattctctttttaaatactgtacagtgaaaaataaatacgccttctcatccaccagacaaggttggtc

SEQ ID NO: 280059 - DNA, 1871 bp, Homo sapiens
gcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtttaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggataccgcgctcagtgatatcattgtcatttgcgtttgtcactggtttgcgtttgg

SEQ ID NO: 280060 - DNA, 1284 bp, Homo sapiens
gactaggtacgaggaccggtgcttagctggctcacttctagttaactaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtttaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaata

SEQ ID NO: 280061 - DNA, 1662 bp, Homo sapiens
gcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtttaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaata

SEQ ID NO: 280062 - DNA, 1728 bp, Homo sapiens
gcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtttaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaata

SEQ ID NO: 280063 - DNA, 2159 bp, Homo sapiens
gcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcaggcccgcctttcttcctcccaactcttgactctgcagctcttggggtgaagccttattcctgatgctccagacgatcaccatctgcttcctggtcatgcactacagaggacagactgtgaaaggtgctggggacttacccaagagcaggctgtgtggttcctgggaaccctgctgggaactcaggtctgggaaagccaaatgatgtggagagattgacaaggactcctgtctccccacccctaggtgtcgctttcctcgcttgctacggcctggtcctgctggtgcttctctcacctctgacgcccttgactgtagtcaccctgctccaggcctccaatgtgcctgctgtggtggtggggagggtgggtaccaggagcaagggacaagatgtggtgggggcagggtcggggggaagagtagaagatcaaagtgtgggggtgttgtacttgggggagcatgggaagagctcaggtgacagagccaaaggtctcaactcctcccctcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtttaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaata

SEQ ID NO: 280064 - DNA, 1742 bp, Homo sapiens
gcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaagcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtttaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaata

SEQ ID NO: 280065 - DNA, 2403 bp, Homo sapiens
  misc_feature (1004)..(1004): n is a, c, g, or t
  misc_feature (1254)..(1254): n is a, c, g, or t
gcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgtgctggattaaaaaaggaggatgaggcccgtcccgtgaggtctgcgtccatgagggttagaggtgggttaggggcatgggggcaccagcaaggggagggttgtatggagtgggagagccagggggcaggtagtgggtataggtgggcagcagttccccctggagcctagggtcactctgagggagggagcacggtgagggggcttccagtttgcagtgggaagagctgcagagagaaacaagaggttagagggcacttccctgggttggaggtgagtctggccagttctgggcagacagggtagagcgtgccacccacccagccctggctacccagccngctgggcgcagcaggcatggaagccgaccccgggatggagagcccgcggccctgttggggcacgctcgggagcgggcttgcgtgctgcacggctgttttcctcttggggagtcaggccaggaaagggcagaatgagctcggcctctccttgccctgggggctgggagaggaagctgggtcacacacaggccagaagcaggggggaaacggggcatctaactaggacacagtcgcatccaggggtcagtcncctgaccctacagggcccaccaccttcagactgagatggaaacgccctctgggagaaccctgatccgccccaccctacacaggccccggaggtactgggcctgcgcccgccacaccttggccgcgagtggcctctgcttgggtgggctcccgtcctccggcatccgcccccaccaaggctccagaagaggggcgcatgggcctccgtcttcggcccgcttcccaggcactcacccatagctgccaggcaggtaggctgtcgagtagctggggggtctgtacccaaagcctctgctcggttgggtggtcgcgtaccccggcccccagagcgggccgccgctggccaggttgcctcttccctgtccgcagcgggaagtccggcgcccgagctcttggccttgcgccgaggccggtacttgtagtcggggtagtcgcgcaggtgtcgggcgcggagccgcttggcctcctccacgaaggccgcttctcgtcctcgtccagcagcttccactgcgcgcccaggcgcttggagatctcggagttgtgcatcttggggttctgctgcgccatctggcggcgctgagcggagctccacaccatgaacgcgttcatcggccgcttcaccttctccaggggcagcgtcccgggggccgcggggctcccagcgccctcccgctcctggggtcccgaagatgaggaggcagcagccgtggcagccggaggctccaggctccaggcctggtcctgtgaggagcctggtagcgccatgggttgggagaagccttaagagggcgtcctgaatgccctcccctcaacgtgaagcgtcgatcctgaaaatggaaaggtcttcccagtctggagtcgttgccgaggaacttgggtccttaaaaagtgtattttatccccaagcccagagcttaaaccggagcctttgcttccaacctgttcggcacactttggggagagtcgaatgcaaaatccgctgtctggtgccccggcactgaagaggtgttctgaggcctactgactgggggacccccggtccctctccccgacccgcagctgcgatcagaccgaccttccgtggagggggtaaaccataaacccctttgtggtctccggagttccgacagctgccaggcgcggataggcc

SEQ ID NO: 280066 - DNA, 931 bp, Homo sapiens
gcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtctaggcggaagggagtggagatggggctggttcctgctgcagtgaggggaacagatgggacaataaagactggagactcagttgaataatacaaaactgtttaatactaccaaaaata

SEQ ID NO: 280067 - DNA, 1458 bp, Homo sapiens
  misc_feature (5)..(6): n is a, c, g, or t
  misc_feature (11)..(11): n is a, c, g, or t
  misc_feature (34)..(35): n is a, c, g, or t
ccctnngcccnaaagtgaacccccccgagcctgnnggccactggagcttgcttatgggggggggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtttaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaata

SEQ ID NO: 280068 - DNA, 1897 bp, Homo sapiens
gcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcaggcccgcctttcttcctcccaactcttgactctgcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtttaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaata

SEQ ID NO: 280069 - DNA, 2002 bp, Homo sapiens
gcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggagggtgggtaccaggagcaagggacaagatgtggtgggggcagggtcggggggaagagtagaagatcaaagtgtgggggtgttgtacttgggggagcatgggaagagctcaggtgacagagccaaaggtctcaactcctcccctcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtttaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaata

SEQ ID NO: 280070 - DNA, 1803 bp, Homo sapiens
gcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgctggggacttacccaagagcaggctgtgtggttcctgggaaccctgctgggaactcagcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtttaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaata

SEQ ID NO: 280071 - DNA, 1047 bp, Homo sapiens
gcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcaggtgaggggcccacccttccaccccaagggtaatacccacaactctaatggggattaaggtgaaggaggttacaaggcagcaaagtggccgggcccagtggcttgcacctgtaaccccagcactttgggaggccgaggcgggtggatcacctgaggtcaggagttcgaactggccaacatggtgaaaccccgtctctactaaaaatacaaaattagctgggtgtggtgatgggcacctgtaatcccagctacttgggaggctgaggcaggagaatcacttgaacctgggagg

SEQ ID NO: 280072 - DNA, 1954 bp, Homo sapiens
gagacgaagtctctgtcgcccaggctggagtgcagtggtggaatcatggctcactgcaacctctgcctcctaggttcaagcgattctcctgcctcagcctcccaagtagctgggattacaggtgcctgccaccacgcccggctgttttttgtatttttagtagagacagggtttcaccatattggccaggctcctgacctcaggtgatccgcctgccttggcctcccagggtgctaggattacatgcatgagccaccgtgcctggcctcagacatcaataatttttaaagattcttttggtgattccaaagtatatcaaaatttgggggatcatagatagaaagactgaaattaagagagtcaagcttaattaaaaatcatggttgacgactgatagtccaaaagacagagtcacaaatcgtgtaaatatttgcaactaagagtcaagaggcatttatttgcagatagaggtgtctggctaaatgttggtctgcttagcaacacagatgaagagtcctataacagttccatatttaatgacagaaactgtagcattagccagtctgtgtgttttaatgaaagttaaccctaggcctaagaaaacctgattttggattccaaagggagtttgaaatcctagcttatttaaagggttttatctcattgcttcccttggtccctgtgaattacagcccttattttttgtgttttctgcaaaactcaagggtcatttattgctgcttagctctgacttttcctttctttaagtgcctctagaagaatgaatgtttgggtcataaatcaattaaaaaattaaaaaattggtttatgaccaacaaaaaagggatgctgaaattactatcaccagattgatatttggttggttagatgggggttttgttcaactttctaaatagtcttggtaaacttgataaggatcatatcatatgatactgaatggtaaggtcagatctggcaggaagtaaaatgaagatcaaagcttgtgtcactattctattaatcatacactgctttctttaactggagtaaagtaaacattgggttttccttctttagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgaaaaaat

SEQ ID NO: 280073 - DNA, 1068 bp, Homo sapiens
cagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgaaaaaat

SEQ ID NO: 280074 - DNA, 800 bp, Homo sapiens
aggagagctggtttcagacttcgagaaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacttgctgctgacacgccgaccgcctgctgcttcagctacacctcccggcagattccacagaatttcatagctgactactttgagacgagcagccagtgctccaagcccggtgtcatcttcctaaccaagcgaagccggcaggtctgtgctgaccccagtgaggagtgggtccagaaatatgtcagcgacctggagctgagtgcctgaggggtccagaagcttcgaggcccagcgacctcggtgggcccagtggggaggagcaggagcctgagccttgggaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcggcctgtgtaggcagtcatggcaccaaagccaccagactgacaaatgtgtatcggatgcttttgttcagggctgtgatcggcctggggaaataataaagatgctcttttaaaaggt

SEQ ID NO: 280075 - DNA, 986 bp, Homo sapiens
aggagagctggtttcagacttcgagaaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacgagtctgagtttcgttgtgggtatcaccactctctggccatggttagaccacatcaatcttttcttgtggcctaaaagcccccaagagaaaagagaacttcttaaagggctgccaaacatcttggtctttctctttaagacttttatttttatctctagaaggggtcttagccccctagtctccagttgctgctgacacgccgaccgcctgctgcttcagctacacctcccggcagattccacagaatttcatagctgactactttgagacgagcagccagtgctccaagcccggtgtcatcttcctaaccaagcgaagccggcaggtctgtgctgaccccagtgaggagtgggtccagaaatatgtcagcgacctggagctgagtgcctgaggggtccagaagcttcgaggcccagcgacctcggtgggcccagtggggaggagcaggagcctgagccttgggaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcggcctgtgtaggcagtcatggcaccaaagccaccagactgacaaatgtgtatcggatgcttttgttcagggctgtgatcggcctggggaaataataaagatgctcttttaaaaggt

SEQ ID NO: 280076 - DNA, 1907 bp, Homo sapiens
aggagagctggtttcagacttcgagaaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacgagtctgagtttcgttgtgggtatcaccactctctggccatggttagaccacatcaatcttttcttgtggcctaaaagcccccaagagaaaagagaacttcttaaagggctgccaaacatcttggtctttctctttaagacttttatttttatctctagaaggggtcttagccccctagtctccaggtatgagaatctaggcaggggcaggggagttacagtcccttttacagatagaaaaacagggttcgaaacgaatcagttagcaagaggcagaatccagggctgcttacttcccagtggggtatgttgttcactctccagctcactctaggtctcccaggagctctgtcccttggatgtcttatgagagatgtccaaggtttctcttgggttggggtatgacttcttgaaccagacaaaattccctgaagagaactgagataagagaacagtccgttcaggtatctggatcacacagagaaacagagaacccactatgaagagtcaaggagaaagaaggatacagacagaaacaaagagacatttctcagcaaaaatgcccaaatgccttccagtcacttggtctgagcaagcctgccttcctcaactgctcggggatcagaagctgcctggccttttcttctgagctgtgactcgggctcattctcttcctttctccacagttgctgctgacacgccgaccgcctgctgcttcagctacacctcccggcagattccacagaatttcatagctgactactttgagacgagcagccagtgctccaagcccggtgtcatgtaagtgccagtcttcctgctcacctctatggaggtagggagggtcagggttggggcagagacaggccagaaggctatcctggaaaggcccagccttcaggagcctatcggggatacaggacgcagggctccgaggtgtgacctgacttggagctggagtgaggcatgtgttacagagtcaggaagggctgccccagcccagaggaaagggacaggaagaaggaggcagcgggacactctgagggcccccttgcctggagtcactgagagaagctctctagacggagataggcagggggcccctgaaagaggagcaagccctgagctgcccaggacagagagcagaatggtggggccatggtgggcccaggattcccctgctggattccccagtgcttaactcttcctcccttctccacagcttcctaaccaagcgaagccggcaggtctgtgctgaccccagtgaggagtgggtccagaaatatgtcagcgacctggagctgagtgcctgaggggtccagaagcttcgaggcccagcgacctcggtgggcccagtggggaggagcaggagcctgagccttgggaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcggcctgtgtaggcagtcatggcaccaaagccaccagactgacaaatgtgtatcggatgcttttgttcagggctgtgatcggcctggggaaataataaagatgctcttttaaaaggt

SEQ ID NO: 280077 - DNA, 1165 bp, Homo sapiens
aggagagctggtttcagacttcgagaaggacacgggcagcagacagtggtcagtcctttcttggctctgctgacactcgagcccacattccgtcacctgctcagaatcatgcaggtctccactgctgcccttgctgtcctcctctgcaccctgcttcagctacacctcccggcagattccacagaatttcatagctgactactttgagacgagcagccagtgctccaagcccggtgtcatgtaagtgccagtcttcctgctcacctctatggaggtagggagggtcagggttggggcagagacaggccagaaggctatcctggaaaggcccagccttcaggagcctatcggggatacaggacgcagggctccgaggtgtgacctgacttggagctggagtgaggcatgtgttacagagtcaggaagggctgccccagcccagaggaaagggacaggaagaaggaggcagcgggacactctgagggcccccttgcctggagtcactgagagaagctctctagacggagataggcagggggcccctgaaagaggagcaagccctgagctgcccaggacagagagcagaatggtggggccatggtgggcccaggattcccctgctggattccccagtgcttaactcttcctcccttctccacagcttcctaaccaagcgaagccggcaggtctgtgctgaccccagtgaggagtgggtccagaaatatgtcagcgacctggagctgagtgcctgaggggtccagaagcttcgaggcccagcgacctcggtgggcccagtggggaggagcaggagcctgagccttgggaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcggcctgtgtaggcagtcatggcaccaaagccaccagactgacaaatgtgtatcggatgcttttgttcagggctgtgatcggcctggggaaataataaagatgctcttttaaaaggt

SEQ ID NO: 280078 - DNA, 346 bp, Homo sapiens
aggagagctggtttcagacttcgagaaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacctcccccttccctcacaccgcgtctggtgacaaccgagtggctgtcatcggcctgtgtaggcagtcatggcaccaaagccaccagactgacaaatgtgtatcggatgcttttgttcagggctgtgatcggcctggggaaataataaagatgctcttttaaaaggt

SEQ ID NO: 280079 - DNA, 1486 bp, Homo sapiens
aggagagctggtttcagacttcgagaaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacgagtctgagtttcgttgtgggtatcaccactctctggccatggttagaccacatcaatcttttcttgtggcctaaaagcccccaagagaaaagagaacttcttaaagggctgccaaacatcttggtctttctctttaagacttttatttttatctctagaaggggtcttagccccctagtctccaggtatgagaatctaggcaggggcaggggagttacagtcccttttacagatagaaaaacagggttcgaaacgaatcagttagcaagaggcagaatccagggctgcttacttcccagtggggtatgttgttcactctccagctcactctaggtctcccaggagctctgtcccttggatgtcttatgagagatgtccaaggtttctcttgggttggggtatgacttcttgaaccagacaaaattccctgaagagaactgagataagagaacagtccgttcaggtatctggatcacacagagaaacagagaacccactatgaagagtcaaggagaaagaaggatacagacagaaacaaagagacatttctcagcaaaaatgcccaaatgccttccagtcacttggtctgagcaagcctgccttcctcaactgctcggggatcagaagctgcctggccttttcttctgagctgtgactcgggctcattctcttcctttctccacagttgctgctgacacgccgaccgcctgctgcttcagctacacctcccggcagattccacagaatttcatagctgactactttgagacgagcagccagtgctccaagcccggtgtcatcttcctaaccaagcgaagccggcaggtctgtgctgaccccagtgaggagtgggtccagaaatatgtcagcgacctggagctgagtgcctgaggggtccagaagcttcgaggcccagcgacctcggtgggcccagtggggaggagcaggagcctgagccttgggaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcggcctgtgtaggcagtcatggcaccaaagccaccagactgacaaatgtgtatcggatgcttttgttcagggctgtgatcggcctggggaaataataaagatgctcttttaaaaggt

SEQ ID NO: 280080 - DNA, 769 bp, Homo sapiens
aggagagctggtttcagacttcgagaaggacacgggcagcagacagtggtcagtcctttcttggctctgctgacactcgagcccacattccgtcacctgctcagaatcatgcaggtctccactgctgcccttgctgtcctcctctgcaccttgctgctgacacgccgaccgcctgctgcttcagctacacctcccggcagattccacagaatttcatagctgactactttgagacgagcagccagtgctccaagcccggtgtcatcttcctaaccaagcgaagccggcaggtctgtgctgaccccagtgaggagtgggtccagaaatatgtcagcgacctggagctgagtgcctgaggggtccagaagcttcgaggcccagcgacctcggtgggcccagtggggaggagcaggagcctgagccttgggaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcggcctgtgtaggcagtcatggcaccaaagccaccagactgacaaatgtgtatcggatgcttttgttcagggctgtgatcggcctggggaaataataaagatgctcttttaaaaggt

SEQ ID NO: 280081 - DNA, 1179 bp, Homo sapiens
aggagagctggtttcagacttcgagaaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacgagtctgagtttcgttgtgggtatcaccactctctggccatggttagaccacatcaatcttttcttgtggcctaaaagcccccaagagaaaagagaacttcttaaagggctgccaaacatcttggtctttctctttaagacttttatttttatctctagaaggggtcttagccccctagtctccaggtatgagaatctaggcaggggcaggggagttacagtcccttttacagatagaaaaacagggttcgaaacgaatcagttagcaagaggcagaatccagggctgcttacttcccagtggggtatgttgttcactctccagctcactctaggtctcccaggagctctgtcccttggatgtcttatgagagatgtccaaggtttctcttgggttggggtatgacttcttgaaccagacaaaattccctgaagagaactgagataagagaacagtccgttcaggtatctggatcacacagagaaacagagaacccactatgaagagtcaaggagaaagaaggatacagacagaaacaaagagacatttctcagcaaaaatgcccaaatgccttccagtcacttggtctgagcaagcctgccttcctcaactgctcggggatcagaagctgcctggccttttcttctgagccttgggaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcggcctgtgtaggcagtcatggcaccaaagccaccagactgacaaatgtgtatcggatgcttttgttcagggctgtgatcggcctggggaaataataaagatgctcttttaaaaggt

SEQ ID NO: 280082 - DNA, 2417 bp, Homo sapiens
  misc_feature (1120)..(1120): n is a, c, g, or t
  misc_feature (1809)..(1809): n is a, c, g, or t
  misc_feature (2416)..(2416): n is a, c, g, or t
agtttcaaaatattctgacaggacacagacagccctggctgaaaggagcacagagagaatacttcgagctcatgctgagagaaaaaggcgagtttgtcttttcttacctgagactgggcctgaagggagagtttcagttcttcattgacggttgctttcaagatgtacctgggaattacaccaagtgtgacctgtaacaattcaagcaaaaatgaattttccctgattctagagaagaatcccctggtggagtttgtggaagagctccctgctgggcgatcttctctgtgctactgcaacttgctctgtgggattatcagaggtgccttggaaatggttcatttggcggctgatgttacattcttgcaagacagactaaaaggtgacagtgtgacagaaataggaataacatttctaaaaaagcgagacgagaaaaaatatagagggaaaaaatgaagactagcacggaaaatgccacggggcggctagctgagttaatgttagctaaacatgtatagacatagaaattttgaattgcttcatagcatgagctttgaaaggtttataaatcagccagaaatttgaaatgcagggcatgaaggcttaaaggtttttttttccttttgcttataaatcacgcattttcaatctcatgtccacaaaatttcatatgcaaatagctccttacaagatagcaggcaggaattccacatcttacactatccatcctcagagaagctgttcattccattcacgtatggtaatgggaaaaaaaagcagcacaaatacaaacagttgtgtatttgtctctttgctgaaaaaaaaagaatgaaatgatatagcatagagtttcctatatatagacagtagtttctagatactgtatattgcattccttaaataaataattccatatttctaaaaaaatatgatttgatttttctcatgtattagcttggcttatagctttagccttctgacgctacccttgatttgtaatcaccaagtcaagctatttattcaatgataattttgaaacatttataaataacatttaattttaatttatttagttttaatatagctggcatcaaccaaattccttccttttctcatgaantattgcttgatggtcaggccaggaaacttctaaaataaaggataaataatattctttgaaattactttcttaccccaaagcttattaattcagaatttctactatcattttcatcctctaaaaaatcttccaaaggatgttttctttgtgaccagaacacatttaaaattcaagtgtaccgaattaaatacacagtaatcttcaccagaccactggcacacaagggcggcctacaaggcagcccagaatctactgggctctgcagagagcccaaattgcaagtacaagttataattagtgtgataccaccctacggaattggagaaaatatttgtaaactatgtatctgacacccttgtgctattaataaccagaatatataaggagttcaaccaactccataggaaaaaattaataatccaattaaagatgggcaaaagatctgaatagacatttctcaaaagaagacatacacatacaaatggcaaacaggtatatgaaaaggtgctcaacatcattggtcatcagagaaatgcaaatcaaaactataatgagatattatctcaccctagttaaaaatggcttttatccaaaacaggcaatagtgaatgcttgcaaagatgtggagaagagggaactctggtacactgttggtgggaatgtaaattagtataaccactatggagaanggtttggaggttcctcaaaaaacaaaaaatagaatgatcatatgatccagcaatcccactgctggatatatacccaaaataaaggaaatcagtatatcaaagagatatctgcactcccatgtttactgcagaactactgacgatagctaagatttggaagaaatctaagtgtccttcaatagattaatgaaataaagaaaatatggtacatatacacaatggagtactattcagccataaagaagaatgagatcctgtcatttgcaaaacatggatggaactagaggtcattatgttcaatgaaatatgtcaggacagaaagacagactttgcatgttctcatttatttgtaggagctaaaaattaaaacagtggactcatggagatatggagtaaaatgatggatatcagaggctgggaagggtagtttcaagaggagtggagatggttaatgggtacaaaaatatagttagatagaatgaataagatctgggtcgggcatggtggcacaagcctgtaatctctgcactttgggatgccaaagtgggaggattgcttgagctcaggagtttgagaccagcttgggtaacatagacccctgtctctnc

SEQ ID NO: 280083 - DNA, 379 bp, Homo sapiens
ccatctgccaccctacactctcaatccctaagtaaaacggattctctggggagacgcagcacatcgcctggctctgcagcccccaccacattgtagcgtacacccgtggaggagtttggggtcacacacttaccggcatggtggctgcctggctgagcccggggacagcatgtactcatccgaagaggggacccatgaccgtggtgtgcacagtacaagagctcgcttgggatctctgataaaggaagtccaccatgcagggttgagctgaaccacagaagcccagcctgggagcagggctccaggacctcccaaggatcagaaacctcaatgataaatttccgactggatgatacacactacacctgttcttcagcga

SEQ ID NO: 280084 - DNA, 735 bp, Homo sapiens
  misc_feature (697)..(697): n is a, c, g, or t
  misc_feature (701)..(701): n is a, c, g, or t
  misc_feature (728)..(729): n is a, c, g, or t
  misc_feature (735)..(735): n is a, c, g, or t
tgccttttccctttccaataagagaggaccattgttgggggagccagaagaccgagagagtagccagtgacagagctccacgtgtctgtgaattggctcatctcctccagcaagaaagatggaatctgagctcagaagagtatgcatgctcaggaaaccagccagcaatcctcccagacggtatcaagaaactgaaatttaccagatccccacatctggaaagtgagaagccagacccctcacccatcatgattccccaggtgaccacctgctgcctgttggccaactcctttccctgccccttctgtgtttatgaagccccagtatctgcttcataaacaccagatgtgcatgtggggggcatctgtctcccacctgagcagaggctcccagtgcccactggggtgagtgagctgcaacgtcttctcagggaggtgaacaaggtgaaatgctgtaacactgactgttggaatctgggagaaagactgaaagaggcagtggtttcccctgtgtctgaatgagtgctcaattattccttgtggcagcatcccgcggatgatcagttgttgcttgcgggctttgttatttcaagtcaataaaacccagatgccgcccggcaaccggcggtgggagcttccagcctttttgttccccttttaagtgaaggggtttaatttccgaagctttggcgtaaatnaatngggtcattaagctggttttccttgtgnngaaaan

SEQ ID NO: 280085 - DNA, 401 bp, Homo sapiens
gctgccttttagagtctcagggaccatctttggaataagatggaaaaatcctccttgaagctgaagaactgtcttctgagcaactggcacaaggaatacgtagaggcacattctacatgggcgactgaatataacacaggaaaaggtctcgtccaaattctgactgataacatctgacaatttctcggatttcctgatttgttcttgtgcacaaaatctcaatcaatacacgttcctgagttcctgctccctacatgaaatgaagggaagattatacaaagaaaaatgaaatttctgcaagtaattaaatcttcgtcaaatatttctttgttctgtagaactaaaaactatatattcagatggatgatgtgaaataaagaattgctttaattaccactgta

SEQ ID NO: 280086 - DNA, 584 bp, Homo sapiens
cggggagtgcggcgcggggacgggcgctgggcggccgcggagctccgggtgccgccgcgtccccagcgccccggccggcccctctgggcggcctgcgggggcggcgcagttgcgaaactgagtgcctgtgtagatcatcctagaatacctgtgtggtgctgtccttcctcaagactacctcattctcactggctcggagactcctgcctgctgaggagagtggtagaggcacagaagatgatgaggctgttgaactgtggaggcatagattagagtgacgtggtcacaagccaaggaacacctgaagccaccaacagcttgaaaaacaaggaaagctttctctcctgcaaccattggagggaccctggcccagctggcactttgatttcagcccagtgaaagtgattttgagcttctgacccccagaactatgagaggaaaatttttgttgtttttatgctcccccagtttgtggtaatttgctactgcatctccaggaaactactgcactttgtactgaaacaaatgtaaaaatagattgtaaatataaaataaaccaaccataagagaaaacactttacaaa

SEQ ID NO: 280087 - DNA, 478 bp, Homo sapiens
gaggacacagctagaaggcaccatcactatcagcgaaccagaaagcaggctctcacccgacgctgagtctgacggtgacttgaccttggactttccagcttccagaaaagagagtggtagaggcacagaagatgatgaggctgttgaactgtggaggcatagattagagtgacgtggtcacaagccaaggaacacctgaagccaccaacagcttgaaaaacaaggaaagctttctctcctgcaaccattggagggaccctggcccagctggcactttgatttcagcccagtgaaagtgattttgagcttctgacccccagaactatgagaggaaaatttttgttgtttttatgctcccccagtttgtggtaatttgctactgcatctccaggaaactactgcactttgtactgaaacaaatgtaaaaatagattgtaaatataaaataaaccaaccataagagaaaacactttacaaa

SEQ ID NO: 280088 - DNA, 5765 bp, Homo sapiens
gaggacacagctagaaggcaccatcactatcagcgaaccagaaagcaggctctcacccgacgctgagtctgacggtgacttgaccttggactttccagcttccagaaaactgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggccacagagcataacagatatttttcataagctaaattgtatgtataaaacatttgcagtgtttcagacactgttgaacaaaaatgtaattggtaagtatgtatccaaacaggcatggggtttcctgatacattatgtgttttgtttctgccctgtcttatcatttacactcatggatcttcagaattaatctaacatggaagttatagatacctgaaagctgggttggtctacttcaggaacattgctttaagtgatgtattttaaaataacccgcttcatatgtatgatctgttggtgtacacaccatgggtaaggtattgcttgcacataatttgctctgcatattatggaccattgtggtttcttccagtcacttagatggaaaggaggttaaacctaggtactttttagcaaggatataaagtcaaattcagcatatgtttttatttttaggcttgacttttacaagacattaatctccatttgtacatatgttattttatttgtaaaaccaaatatgactcaacacctttttgatgagtagtgacttaactaagatttacaagtaatatttagacagattcagtcagacaccacttagccatttttacattccctctggttagatttggtacagtataattaagactttaatctgaaatttaaagtagttttaattctgaagaagttacatcctctgtattatttacatgcaacaaaataaaagtggattaatatagtaatgccatggtaacaatagagctatgtcttatgcatgaaggcaactttggatgttttaacacatttgactgactttggtttagtgaatgctgacaatgctgctctacttaggtttcctatgaaatttttaagaatggctatgagactgtatagaagcttctagagaactgaaagtcataatgcagagttgccttttctagtgcagctaagtggcggacctcaactgaagatatgagtttctttgggttcttggagttatcaaattgatcttgccattatgttactttgcaaataactgaagtaaatgattcttacctaaataaccacaacctgtacacatttgctcacaatttatagtagttattttctatctacctatatttaaaattaggatgattaaaaaataatttatagattttgtgacagtaatgatttacatatgcccaatatatgccttatttttaaataagtcattctgtataaagtcattttgttgttgttcagagaaatcaagatcttattcacaaagaaaaacattttataaattgatcgcattttctttaagtcaaaatgttaaactggaggcagtattaaactttgcaattaggagtttcagagatgccttggcataccacgaaaaacactgtcaatatccaactcattataaattgttatcagaattaacctaataactttaagtaaggacaagcagcatcctagcaacttgtagtagtcttgggttcccagcagagtatcacagttaacctctctgacaacttcatcagaatttccaagctgccaaataatcttcatagacctaattacagatttaaaaaaatttcctaggcgacgaaagtatagaaatgtgaatatgatgaatacattgagaagctgtactttttaattagttatattacttctggaagcacatatctaaggaatattttctaagactcagagggaaaaaaactcgttttcataggatcatctgaagatactttagtatatttgtgatcatttttatctattgcaaatacaaatgaattagataagtgccacatcctggatacatttcggaggggtagtgggcaatggtatacaaaaataccaaatataaaattttcatctgggggaatgttcaggttctaaatactaaattagatttcaatgttttgtgtttttttaaaaaaaatcatattgcaacttgttttattgtgattttctacaagtattaaatacatttaaagatctttttatcttaccaagaaataatttggaatagcattggtatatttgaccttttgagtgtctgtcatcctcagagaatggcccatagtgtgttgcctgtggacatagtgtccatagtccctttcttgtccttctgagatattttggtttgataacattttgttttttgtcttgatgcacagggacttttttataatatgagacttcagttggtattaataggagttacctatttaattctcccagtcatcaatgaggtaatcatcaattcctatagttcaaattagtcataaacaagagctacagcaagactgatagagtaaaaactatataaatacagtaaaaaaaaatagaatttatggtgtgaaatatgaagtatagcaatatataacaagaacatgtaagcacttgcttccacagcataaatgtaatttacatctgcattaaaggataattttctctgtgaataagagcaaaatggtcttcagagaaacagactgttcatttgaagccatttctgtaaacatcttccaagatagaactgtaatggattgaggaaataacacagaaaagacaaaaacttttgatttcaggcatgcaaagtgcgtgggcagatggacagttcccattgtgcattgcctttgataaattgggccttaatttatataacgatgctgtgttcacatccctctcctacctaaagttgtctttattggtttatattgtgttaaaattagcttataattattacttttgtattgtgttcagttttttaagttgcatgtttatactatttgctacagtatttttaagtttggggtgaaggccatcagctgtatcaaaaagacaaaacaatcactatttattcagtattgctgctttacatctccagaataagctttcgatgccaggacagtgactgcctgaaagctgcaggagctcttttcaatgcattttatatatttttagaaaccaaataaatgcagaaaactatttagtatactaattatattaaaccagcagaaatataaaggcaataaagtatatacatatatatggggggaggggaaagattaaaaaatagatttacagccagacatggtgatagccctaaatgtatttctcaatatgtttttctttattgaccctaggaggatttgagttgctgcagctttaaacagaaaattgccatgttcactaattgtgagcacataaatatgcttttagtactgctttgcttatgtacaaataaatctgtaatatgtattatatgtaattatccttttctttgactttcattttaaatgtatattttctgatcattatgagctgtaaaacaaagaatcaatattggatattctcccaaataataaattttcaggattcattggggcaaaaaaaaacaagaagaacaacaaaaatttgttgggcggcctaggcccaaaaaagttttaaacaccattcgtggtggcgcggggcccaggtaggtaagtaacctggccaaagcgggcccaaggaaacgggacagacacaggctgggtccaccaaaaaaacgcgggggaacggacggctggaaaaccaaggagtcgaggcaacggactacaagggccaaggacagtatcgcacgcccggg

SEQ ID NO: 280089 - DNA, 5590 bp, Homo sapiens
cggggagtgcggcgcggggacgggcgctgggcggccgcggagctccgggtgccgccgcgtccccagcgccccggccggcccctctgggcggcctgcgggggcggcgcagttgcgaaactgagtgcctgtgtagatcatcctagaatacctgtgtggtgctgtccttcctcaagactacctcattctcactggctcggagactcctgcctgctgagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggccacagagcataacagatatttttcataagctaaattgtatgtataaaacatttgcagtgtttcagacactgttgaacaaaaatgtaattggtaagtatgtatccaaacaggcatggggtttcctgatacattatgtgttttgtttctgccctgtcttatcatttacactcatggatcttcagaattaatctaacatggaagttatagatacctgaaagctgggttggtctacttcaggaacattgctttaagtgatgtattttaaaataacccgcttcatatgtatgatctgttggtgtacacaccatgggtaaggtattgcttgcacataatttgctctgcatattatggaccattgtggtttcttccagtcacttagatggaaaggaggttaaacctaggtactttttagcaaggatataaagtcaaattcagcatatgtttttatttttaggcttgacttttacaagacattaatctccatttgtacatatgttattttatttgtaaaaccaaatatgactcaacacctttttgatgagtagtgacttaactaagatttacaagtaatatttagacagattcagtcagacaccacttagccatttttacattccctctggttagatttggtacagtataattaagactttaatctgaaatttaaagtagttttaattctgaagaagttacatcctctgtattatttacatgcaacaaaataaaagtggattaatatagtaatgccatggtaacaatagagctatgtcttatgcatgaaggcaactttggatgttttaacacatttgactgactttggtttagtgaatgctgacaatgctgctctacttaggtttcctatgaaatttttaagaatggctatgagactgtatagaagcttctagagaactgaaagtcataatgcagagttgccttttctagtgcagctaagtggcggacctcaactgaagatatgagtttctttgggttcttggagttatcaaattgatcttgccattatgttactttgcaaataactgaagtaaatgattcttacctaaataaccacaacctgtacacatttgctcacaatttatagtagttattttctatctacctatatttaaaattaggatgattaaaaaataatttatagattttgtgacagtaatgatttacatatgcccaatatatgccttatttttaaataagtcattctgtataaagtcattttgttgttgttcagagaaatcaagatcttattcacaaagaaaaacattttataaattgatcgcattttctttaagtcaaaatgttaaactggaggcagtattaaactttgcaattaggagtttcagagatgccttggcataccacgaaaaacactgtcaatatccaactcattataaattgttatcagaattaacctaataactttaagtaaggacaagcagcatcctagcaacttgtagtagtcttgggttcccagcagagtatcacagttaacctctctgacaacttcatcagaatttccaagctgccaaataatcttcatagacctaattacagatttaaaaaaatttcctaggcgacgaaagtatagaaatgtgaatatgatgaatacattgagaagctgtactttttaattagttatattacttctggaagcacatatctaaggaatattttctaagactcagagggaaaaaaactcgttttcataggatcatctgaagatactttagtatatttgtgatcatttttatctattgcaaatacaaatgaattagataagtgccacatcctggatacatttcggaggggtagtgggcaatggtatacaaaaataccaaatataaaattttcatctgggggaatgttcaggttctaaatactaaattagatttcaatgttttgtgtttttttaaaaaaaatcatattgcaacttgttttattgtgattttctacaagtattaaatacatttaaagatctttttatcttaccaagaaataatttggaatagcattggtatatttgaccttttgagtgtctgtcatcctcagagaatggcccatagtgtgttgcctgtggacatagtgtccatagtccctttcttgtccttctgagatattttggtttgataacattttgttttttgtcttgatgcacagggacttttttataatatgagacttcagttggtattaataggagttacctatttaattctcccagtcatcaatgaggtaatcatcaattcctatagttcaaattagtcataaacaagagctacagcaagactgatagagtaaaaactatataaatacagtaaaaaaaaatagaatttatggtgtgaaatatgaagtatagcaatatataacaagaacatgtaagcacttgcttccacagcataaatgtaatttacatctgcattaaaggataattttctctgtgaataagagcaaaatggtcttcagagaaacagactgttcatttgaagccatttctgtaaacatcttccaagatagaactgtaatggattgaggaaataacacagaaaagacaaaaacttttgatttcaggcatgcaaagtgcgtgggcagatggacagttcccattgtgcattgcctttgataaattgggccttaatttatataacgatgctgtgttcacatccctctcctacctaaagttgtctttattggtttatattgtgttaaaattagcttataattattacttttgtattgtgttcagttttttaagttgcatgtttatactatttgctacagtatttttaagtttggggtgaaggccatcagctgtatcaaaaagacaaaacaatcactatttattcagtattgctgctttacatctccagaataagctttcgatgccaggacagtgactgcctgaaagctgcaggagctcttttcaatgcattttatatatttttagaaaccaaataaatgcagaaaactatttagtatactaattatattaaaccagcagaaatataaaggcaataaagtatatacatatatatggggggaggggaaagattaaaaaatagatttacagccagacatggtgatagccctaaatgtatttctcaatatgtttttctttattgaccctaggaggatttgagttgctgcagctttaaacagaaaattgccatgttcactaattgtgagcacataaatatgcttttagtactgctttgcttatgtacaaataaatctgtaatatgtattatatgtaattatccttttctttgactttcattttaaatgtatattttctgatcattatgagctgtaaaacaaagaatcaatattggatattctcccaaataataaattttcaggattcattggggca

SEQ ID NO: 280090 - DNA, 5539 bp, Homo sapiens
cggggagtgcggcgcggggacgggcgctgggcggccgcggagctccgggtgccgccgcgtccccagcgccccggccggcccctctgggcggcctgcgggggcggcgcagttgcgaaactgactgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggccacagagcataacagatatttttcataagctaaattgtatgtataaaacatttgcagtgtttcagacactgttgaacaaaaatgtaattggtaagtatgtatccaaacaggcatggggtttcctgatacattatgtgttttgtttctgccctgtcttatcatttacactcatggatcttcagaattaatctaacatggaagttatagatacctgaaagctgggttggtctacttcaggaacattgctttaagtgatgtattttaaaataacccgcttcatatgtatgatctgttggtgtacacaccatgggtaaggtattgcttgcacataatttgctctgcatattatggaccattgtggtttcttccagtcacttagatggaaaggaggttaaacctaggtactttttagcaaggatataaagtcaaattcagcatatgtttttatttttaggcttgacttttacaagacattaatctccatttgtacatatgttattttatttgtaaaaccaaatatgactcaacacctttttgatgagtagtgacttaactaagatttacaagtaatatttagacagattcagtcagacaccacttagccatttttacattccctctggttagatttggtacagtataattaagactttaatctgaaatttaaagtagttttaattctgaagaagttacatcctctgtattatttacatgcaacaaaataaaagtggattaatatagtaatgccatggtaacaatagagctatgtcttatgcatgaaggcaactttggatgttttaacacatttgactgactttggtttagtgaatgctgacaatgctgctctacttaggtttcctatgaaatttttaagaatggctatgagactgtatagaagcttctagagaactgaaagtcataatgcagagttgccttttctagtgcagctaagtggcggacctcaactgaagatatgagtttctttgggttcttggagttatcaaattgatcttgccattatgttactttgcaaataactgaagtaaatgattcttacctaaataaccacaacctgtacacatttgctcacaatttatagtagttattttctatctacctatatttaaaattaggatgattaaaaaataatttatagattttgtgacagtaatgatttacatatgcccaatatatgccttatttttaaataagtcattctgtataaagtcattttgttgttgttcagagaaatcaagatcttattcacaaagaaaaacattttataaattgatcgcattttctttaagtcaaaatgttaaactggaggcagtattaaactttgcaattaggagtttcagagatgccttggcataccacgaaaaacactgtcaatatccaactcattataaattgttatcagaattaacctaataactttaagtaaggacaagcagcatcctagcaacttgtagtagtcttgggttcccagcagagtatcacagttaacctctctgacaacttcatcagaatttccaagctgccaaataatcttcatagacctaattacagatttaaaaaaatttcctaggcgacgaaagtatagaaatgtgaatatgatgaatacattgagaagctgtactttttaattagttatattacttctggaagcacatatctaaggaatattttctaagactcagagggaaaaaaactcgttttcataggatcatctgaagatactttagtatatttgtgatcatttttatctattgcaaatacaaatgaattagataagtgccacatcctggatacatttcggaggggtagtgggcaatggtatacaaaaataccaaatataaaattttcatctgggggaatgttcaggttctaaatactaaattagatttcaatgttttgtgtttttttaaaaaaaatcatattgcaacttgttttattgtgattttctacaagtattaaatacatttaaagatctttttatcttaccaagaaataatttggaatagcattggtatatttgaccttttgagtgtctgtcatcctcagagaatggcccatagtgtgttgcctgtggacatagtgtccatagtccctttcttgtccttctgagatattttggtttgataacattttgttttttgtcttgatgcacagggacttttttataatatgagacttcagttggtattaataggagttacctatttaattctcccagtcatcaatgaggtaatcatcaattcctatagttcaaattagtcataaacaagagctacagcaagactgatagagtaaaaactatataaatacagtaaaaaaaaatagaatttatggtgtgaaatatgaagtatagcaatatataacaagaacatgtaagcacttgcttccacagcataaatgtaatttacatctgcattaaaggataattttctctgtgaataagagcaaaatggtcttcagagaaacagactgttcatttgaagccatttctgtaaacatcttccaagatagaactgtaatggattgaggaaataacacagaaaagacaaaaacttttgatttcaggcatgcaaagtgcgtgggcagatggacagttcccattgtgcattgcctttgataaattgggccttaatttatataacgatgctgtgttcacatccctctcctacctaaagttgtctttattggtttatattgtgttaaaattagcttataattattacttttgtattgtgttcagttttttaagttgcatgtttatactatttgctacagtatttttaagtttggggtgaaggccatcagctgtatcaaaaagacaaaacaatcactatttattcagtattgctgctttacatctccagaataagctttcgatgccaggacagtgactgcctgaaagctgcaggagctcttttcaatgcattttatatatttttagaaaccaaataaatgcagaaaactatttagtatactaattatattaaaccagcagaaatataaaggcaataaagtatatacatatatatggggggaggggaaagattaaaaaatagatttacagccagacatggtgatagccctaaatgtatttctcaatatgtttttctttattgaccctaggaggatttgagttgctgcagctttaaacagaaaattgccatgttcactaattgtgagcacataaatatgcttttagtactgctttgcttatgtacaaataaatctgtaatatgtattatatgtaattatccttttctttgactttcattttaaatgtatattttctgatcattatgagctgtaaaacaaagaatcaatattggatattctcccaaataataaattttcaggattcattggggca

SEQ ID NO: 280091 - DNA, 5496 bp, Homo sapiens
cggggagtgcggcgcggggacgggcgctgggcggccgcggagctccgggtgccgccgcgtccccagcgccccggccggcccctctgggcggcctgcgggggcggcgcagttgcgaaactgactagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggccacagagcataacagatatttttcataagctaaattgtatgtataaaacatttgcagtgtttcagacactgttgaacaaaaatgtaattggtaagtatgtatccaaacaggcatggggtttcctgatacattatgtgttttgtttctgccctgtcttatcatttacactcatggatcttcagaattaatctaacatggaagttatagatacctgaaagctgggttggtctacttcaggaacattgctttaagtgatgtattttaaaataacccgcttcatatgtatgatctgttggtgtacacaccatgggtaaggtattgcttgcacataatttgctctgcatattatggaccattgtggtttcttccagtcacttagatggaaaggaggttaaacctaggtactttttagcaaggatataaagtcaaattcagcatatgtttttatttttaggcttgacttttacaagacattaatctccatttgtacatatgttattttatttgtaaaaccaaatatgactcaacacctttttgatgagtagtgacttaactaagatttacaagtaatatttagacagattcagtcagacaccacttagccatttttacattccctctggttagatttggtacagtataattaagactttaatctgaaatttaaagtagttttaattctgaagaagttacatcctctgtattatttacatgcaacaaaataaaagtggattaatatagtaatgccatggtaacaatagagctatgtcttatgcatgaaggcaactttggatgttttaacacatttgactgactttggtttagtgaatgctgacaatgctgctctacttaggtttcctatgaaatttttaagaatggctatgagactgtatagaagcttctagagaactgaaagtcataatgcagagttgccttttctagtgcagctaagtggcggacctcaactgaagatatgagtttctttgggttcttggagttatcaaattgatcttgccattatgttactttgcaaataactgaagtaaatgattcttacctaaataaccacaacctgtacacatttgctcacaatttatagtagttattttctatctacctatatttaaaattaggatgattaaaaaataatttatagattttgtgacagtaatgatttacatatgcccaatatatgccttatttttaaataagtcattctgtataaagtcattttgttgttgttcagagaaatcaagatcttattcacaaagaaaaacattttataaattgatcgcattttctttaagtcaaaatgttaaactggaggcagtattaaactttgcaattaggagtttcagagatgccttggcataccacgaaaaacactgtcaatatccaactcattataaattgttatcagaattaacctaataactttaagtaaggacaagcagcatcctagcaacttgtagtagtcttgggttcccagcagagtatcacagttaacctctctgacaacttcatcagaatttccaagctgccaaataatcttcatagacctaattacagatttaaaaaaatttcctaggcgacgaaagtatagaaatgtgaatatgatgaatacattgagaagctgtactttttaattagttatattacttctggaagcacatatctaaggaatattttctaagactcagagggaaaaaaactcgttttcataggatcatctgaagatactttagtatatttgtgatcatttttatctattgcaaatacaaatgaattagataagtgccacatcctggatacatttcggaggggtagtgggcaatggtatacaaaaataccaaatataaaattttcatctgggggaatgttcaggttctaaatactaaattagatttcaatgttttgtgtttttttaaaaaaaatcatattgcaacttgttttattgtgattttctacaagtattaaatacatttaaagatctttttatcttaccaagaaataatttggaatagcattggtatatttgaccttttgagtgtctgtcatcctcagagaatggcccatagtgtgttgcctgtggacatagtgtccatagtccctttcttgtccttctgagatattttggtttgataacattttgttttttgtcttgatgcacagggacttttttataatatgagacttcagttggtattaataggagttacctatttaattctcccagtcatcaatgaggtaatcatcaattcctatagttcaaattagtcataaacaagagctacagcaagactgatagagtaaaaactatataaatacagtaaaaaaaaatagaatttatggtgtgaaatatgaagtatagcaatatataacaagaacatgtaagcacttgcttccacagcataaatgtaatttacatctgcattaaaggataattttctctgtgaataagagcaaaatggtcttcagagaaacagactgttcatttgaagccatttctgtaaacatcttccaagatagaactgtaatggattgaggaaataacacagaaaagacaaaaacttttgatttcaggcatgcaaagtgcgtgggcagatggacagttcccattgtgcattgcctttgataaattgggccttaatttatataacgatgctgtgttcacatccctctcctacctaaagttgtctttattggtttatattgtgttaaaattagcttataattattacttttgtattgtgttcagttttttaagttgcatgtttatactatttgctacagtatttttaagtttggggtgaaggccatcagctgtatcaaaaagacaaaacaatcactatttattcagtattgctgctttacatctccagaataagctttcgatgccaggacagtgactgcctgaaagctgcaggagctcttttcaatgcattttatatatttttagaaaccaaataaatgcagaaaactatttagtatactaattatattaaaccagcagaaatataaaggcaataaagtatatacatatatatggggggaggggaaagattaaaaaatagatttacagccagacatggtgatagccctaaatgtatttctcaatatgtttttctttattgaccctaggaggatttgagttgctgcagctttaaacagaaaattgccatgttcactaattgtgagcacataaatatgcttttagtactgctttgcttatgtacaaataaatctgtaatatgtattatatgtaattatccttttctttgactttcattttaaatgtatattttctgatcattatgagctgtaaaacaaagaatcaatattggatattctcccaaataataaattttcaggattcattggggca

SEQ ID NO: 280092 - DNA, 2839 bp, Homo sapiens
gaggacacagctagaaggcaccatcactatcagcgaaccagaaagcaggctctcacccgacgctgagtctgacggtgacttgaccttggactttccagcttccagaaaactgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggccacagagcataacagatatttttcataagctaaattgtatgtataaaacatttgcagtgtttcagacactgttgaacaaaaatgtaattggtaagtatgtatccaaacaggcatggggtttcctgatacattatgtgttttgtttctgccctgtcttatcatttacactcatggatcttcagaattaatctaacatggaagttatagatacctgaaagctgggttggtctacttcaggaacattgctttaagtgatgtattttaaaataacccgcttcatatgtatgatctgttggtgtacacaccatgggtaaggtattgcttgcacataatttgctctgcatattatggaccattgtggtttcttccagtcacttagatggaaaggaggttaaacctaggtactttttagcaaggatataaagtcaaattcagcatatgtttttatttttaggcttgacttttacaagacattaatctccatttgtacatatgttattttatttgtaaaaccaaatatgactcaacacctttttgatgagtagtgacttaactaagatttacaagtaatatttagacagattccaggtcaggaacacccaacttttaaggccccaaattttttttttaaccattccccctcctggtgggttttaaaggaaattttggtacaggtataatttaaaggacttttatc

SEQ ID NO: 280093 - DNA, 5527 bp, Homo sapiens
gaggacacagctagaaggcaccatcactatcagcgaaccagaaagcaggctctcacccgacgctgagtctgacggtgacttgaccttggactttccagcttccagaaaactgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggccacagagcataacagatatttttcataagctaaattgtatgtataaaacatttgcagtgtttcagacactgttgaacaaaaatgtaattggtaagtatgtatccaaacaggcatggggtttcctgatacattatgtgttttgtttctgccctgtcttatcatttacactcatggatcttcagaattaatctaacatggaagttatagatacctgaaagctgggttggtctacttcaggaacattgctttaagtgatgtattttaaaataacccgcttcatatgtatgatctgttggtgtacacaccatgggtaaggtattgcttgcacataatttgctctgcatattatggaccattgtggtttcttccagtcacttagatggaaaggaggttaaacctaggtactttttagcaaggatataaagtcaaattcagcatatgtttttatttttaggcttgacttttacaagacattaatctccatttgtacatatgttattttatttgtaaaaccaaatatgactcaacacctttttgatgagtagtgacttaactaagatttacaagtaatatttagacagattcagtcagacaccacttagccatttttacattccctctggttagatttggtacagtataattaagactttaatctgaaatttaaagtagttttaattctgaagaagttacatcctctgtattatttacatgcaacaaaataaaagtggattaatatagtaatgccatggtaacaatagagctatgtcttatgcatgaaggcaactttggatgttttaacacatttgactgactttggtttagtgaatgctgacaatgctgctctacttaggtttcctatgaaatttttaagaatggctatgagactgtatagaagcttctagagaactgaaagtcataatgcagagttgccttttctagtgcagctaagtggcggacctcaactgaagatatgagtttctttgggttcttggagttatcaaattgatcttgccattatgttactttgcaaataactgaagtaaatgattcttacctaaataaccacaacctgtacacatttgctcacaatttatagtagttattttctatctacctatatttaaaattaggatgattaaaaaataatttatagattttgtgacagtaatgatttacatatgcccaatatatgccttatttttaaataagtcattctgtataaagtcattttgttgttgttcagagaaatcaagatcttattcacaaagaaaaacattttataaattgatcgcattttctttaagtcaaaatgttaaactggaggcagtattaaactttgcaattaggagtttcagagatgccttggcataccacgaaaaacactgtcaatatccaactcattataaattgttatcagaattaacctaataactttaagtaaggacaagcagcatcctagcaacttgtagtagtcttgggttcccagcagagtatcacagttaacctctctgacaacttcatcagaatttccaagctgccaaataatcttcatagacctaattacagatttaaaaaaatttcctaggcgacgaaagtatagaaatgtgaatatgatgaatacattgagaagctgtactttttaattagttatattacttctggaagcacatatctaaggaatattttctaagactcagagggaaaaaaactcgttttcataggatcatctgaagatactttagtatatttgtgatcatttttatctattgcaaatacaaatgaattagataagtgccacatcctggatacatttcggaggggtagtgggcaatggtatacaaaaataccaaatataaaattttcatctgggggaatgttcaggttctaaatactaaattagatttcaatgttttgtgtttttttaaaaaaaatcatattgcaacttgttttattgtgattttctacaagtattaaatacatttaaagatctttttatcttaccaagaaataatttggaatagcattggtatatttgaccttttgagtgtctgtcatcctcagagaatggcccatagtgtgttgcctgtggacatagtgtccatagtccctttcttgtccttctgagatattttggtttgataacattttgttttttgtcttgatgcacagggacttttttataatatgagacttcagttggtattaataggagttacctatttaattctcccagtcatcaatgaggtaatcatcaattcctatagttcaaattagtcataaacaagagctacagcaagactgatagagtaaaaactatataaatacagtaaaaaaaaatagaatttatggtgtgaaatatgaagtatagcaatatataacaagaacatgtaagcacttgcttccacagcataaatgtaatttacatctgcattaaaggataattttctctgtgaataagagcaaaatggtcttcagagaaacagactgttcatttgaagccatttctgtaaacatcttccaagatagaactgtaatggattgaggaaataacacagaaaagacaaaaacttttgatttcaggcatgcaaagtgcgtgggcagatggacagttcccattgtgcattgcctttgataaattgggccttaatttatataacgatgctgtgttcacatccctctcctacctaaagttgtctttattggtttatattgtgttaaaattagcttataattattacttttgtattgtgttcagttttttaagttgcatgtttatactatttgctacagtatttttaagtttggggtgaaggccatcagctgtatcaaaaagacaaaacaatcactatttattcagtattgctgctttacatctccagaataagctttcgatgccaggacagtgactgcctgaaagctgcaggagctcttttcaatgcattttatatatttttagaaaccaaataaatgcagaaaactatttagtatactaattatattaaaccagcagaaatataaaggcaataaagtatatacatatatatggggggaggggaaagattaaaaaatagatttacagccagacatggtgatagccctaaatgtatttctcaatatgtttttctttattgaccctaggaggatttgagttgctgcagctttaaacagaaaattgccatgttcactaattgtgagcacataaatatgcttttagtactgctttgcttatgtacaaataaatctgtaatatgtattatatgtaattatccttttctttgactttcattttaaatgtatattttctgatcattatgagctgtaaaacaaagaatcaatattggatattctcccaaataataaattttcaggattcattggggca

SEQ ID NO: 280094 - DNA, 5633 bp, Homo sapiens
cggggagtgcggcgcggggacgggcgctgggcggccgcggagctccgggtgccgccgcgtccccagcgccccggccggcccctctgggcggcctgcgggggcggcgcagttgcgaaactgagtgcctgtgtagatcatcctagaatacctgtgtggtgctgtccttcctcaagactacctcattctcactggctcggagactcctgcctgctgagctgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggccacagagcataacagatatttttcataagctaaattgtatgtataaaacatttgcagtgtttcagacactgttgaacaaaaatgtaattggtaagtatgtatccaaacaggcatggggtttcctgatacattatgtgttttgtttctgccctgtcttatcatttacactcatggatcttcagaattaatctaacatggaagttatagatacctgaaagctgggttggtctacttcaggaacattgctttaagtgatgtattttaaaataacccgcttcatatgtatgatctgttggtgtacacaccatgggtaaggtattgcttgcacataatttgctctgcatattatggaccattgtggtttcttccagtcacttagatggaaaggaggttaaacctaggtactttttagcaaggatataaagtcaaattcagcatatgtttttatttttaggcttgacttttacaagacattaatctccatttgtacatatgttattttatttgtaaaaccaaatatgactcaacacctttttgatgagtagtgacttaactaagatttacaagtaatatttagacagattcagtcagacaccacttagccatttttacattccctctggttagatttggtacagtataattaagactttaatctgaaatttaaagtagttttaattctgaagaagttacatcctctgtattatttacatgcaacaaaataaaagtggattaatatagtaatgccatggtaacaatagagctatgtcttatgcatgaaggcaactttggatgttttaacacatttgactgactttggtttagtgaatgctgacaatgctgctctacttaggtttcctatgaaatttttaagaatggctatgagactgtatagaagcttctagagaactgaaagtcataatgcagagttgccttttctagtgcagctaagtggcggacctcaactgaagatatgagtttctttgggttcttggagttatcaaattgatcttgccattatgttactttgcaaataactgaagtaaatgattcttacctaaataaccacaacctgtacacatttgctcacaatttatagtagttattttctatctacctatatttaaaattaggatgattaaaaaataatttatagattttgtgacagtaatgatttacatatgcccaatatatgccttatttttaaataagtcattctgtataaagtcattttgttgttgttcagagaaatcaagatcttattcacaaagaaaaacattttataaattgatcgcattttctttaagtcaaaatgttaaactggaggcagtattaaactttgcaattaggagtttcagagatgccttggcataccacgaaaaacactgtcaatatccaactcattataaattgttatcagaattaacctaataactttaagtaaggacaagcagcatcctagcaacttgtagtagtcttgggttcccagcagagtatcacagttaacctctctgacaacttcatcagaatttccaagctgccaaataatcttcatagacctaattacagatttaaaaaaatttcctaggcgacgaaagtatagaaatgtgaatatgatgaatacattgagaagctgtactttttaattagttatattacttctggaagcacatatctaaggaatattttctaagactcagagggaaaaaaactcgttttcataggatcatctgaagatactttagtatatttgtgatcatttttatctattgcaaatacaaatgaattagataagtgccacatcctggatacatttcggaggggtagtgggcaatggtatacaaaaataccaaatataaaattttcatctgggggaatgttcaggttctaaatactaaattagatttcaatgttttgtgtttttttaaaaaaaatcatattgcaacttgttttattgtgattttctacaagtattaaatacatttaaagatctttttatcttaccaagaaataatttggaatagcattggtatatttgaccttttgagtgtctgtcatcctcagagaatggcccatagtgtgttgcctgtggacatagtgtccatagtccctttcttgtccttctgagatattttggtttgataacattttgttttttgtcttgatgcacagggacttttttataatatgagacttcagttggtattaataggagttacctatttaattctcccagtcatcaatgaggtaatcatcaattcctatagttcaaattagtcataaacaagagctacagcaagactgatagagtaaaaactatataaatacagtaaaaaaaaatagaatttatggtgtgaaatatgaagtatagcaatatataacaagaacatgtaagcacttgcttccacagcataaatgtaatttacatctgcattaaaggataattttctctgtgaataagagcaaaatggtcttcagagaaacagactgttcatttgaagccatttctgtaaacatcttccaagatagaactgtaatggattgaggaaataacacagaaaagacaaaaacttttgatttcaggcatgcaaagtgcgtgggcagatggacagttcccattgtgcattgcctttgataaattgggccttaatttatataacgatgctgtgttcacatccctctcctacctaaagttgtctttattggtttatattgtgttaaaattagcttataattattacttttgtattgtgttcagttttttaagttgcatgtttatactatttgctacagtatttttaagtttggggtgaaggccatcagctgtatcaaaaagacaaaacaatcactatttattcagtattgctgctttacatctccagaataagctttcgatgccaggacagtgactgcctgaaagctgcaggagctcttttcaatgcattttatatatttttagaaaccaaataaatgcagaaaactatttagtatactaattatattaaaccagcagaaatataaaggcaataaagtatatacatatatatggggggaggggaaagattaaaaaatagatttacagccagacatggtgatagccctaaatgtatttctcaatatgtttttctttattgaccctaggaggatttgagttgctgcagctttaaacagaaaattgccatgttcactaattgtgagcacataaatatgcttttagtactgctttgcttatgtacaaataaatctgtaatatgtattatatgtaattatccttttctttgactttcattttaaatgtatattttctgatcattatgagctgtaaaacaaagaatcaatattggatattctcccaaataataaattttcaggattcattggggca

SEQ ID NO: 280095 - DNA, 6073 bp, Homo sapiens
tgttgaatcggagtggtgaaagtaggcatccttgtcttgttccagtttttggaggaaatgctttcaattttcctcatttagtatgatgttagctgtgggtttatagtacatgatgtttattattttagcacattgtattattgaagattcaaaaacatatacatgacacacatataaataacctatacataaatgtaactcattcatctagagttaatttttatatatggtgacatggatccagtttcattcatctacattcagctaattaatttcccagcaccatatattgaagagggtgtcctttcctcatgtatggtatgttccttctgtgcctagtttgttgagtgtttttatcatgaagggatgttgaattttatcaaatgctgtttctgtgtctattgagatgatcatatggtttttatccttgattttgtttaggtgatgtatcacatttattgatttgcatatgttgaaccatccttgcatgcctgatataaaacccatttgatcataatggattatctttttgatgtgctgttgagttcagtgggctcgtgttttgttgaagatttttgcatctgtgttcatcatgaatattgcagacctttgtctctgtaattcccaattctggcagtgggagaagtaaggtaagctgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggccacagagcataacagatatttttcataagctaaattgtatgtataaaacatttgcagtgtttcagacactgttgaacaaaaatgtaattggtaagtatgtatccaaacaggcatggggtttcctgatacattatgtgttttgtttctgccctgtcttatcatttacactcatggatcttcagaattaatctaacatggaagttatagatacctgaaagctgggttggtctacttcaggaacattgctttaagtgatgtattttaaaataacccgcttcatatgtatgatctgttggtgtacacaccatgggtaaggtattgcttgcacataatttgctctgcatattatggaccattgtggtttcttccagtcacttagatggaaaggaggttaaacctaggtactttttagcaaggatataaagtcaaattcagcatatgtttttatttttaggcttgacttttacaagacattaatctccatttgtacatatgttattttatttgtaaaaccaaatatgactcaacacctttttgatgagtagtgacttaactaagatttacaagtaatatttagacagattcagtcagacaccacttagccatttttacattccctctggttagatttggtacagtataattaagactttaatctgaaatttaaagtagttttaattctgaagaagttacatcctctgtattatttacatgcaacaaaataaaagtggattaatatagtaatgccatggtaacaatagagctatgtcttatgcatgaaggcaactttggatgttttaacacatttgactgactttggtttagtgaatgctgacaatgctgctctacttaggtttcctatgaaatttttaagaatggctatgagactgtatagaagcttctagagaactgaaagtcataatgcagagttgccttttctagtgcagctaagtggcggacctcaactgaagatatgagtttctttgggttcttggagttatcaaattgatcttgccattatgttactttgcaaataactgaagtaaatgattcttacctaaataaccacaacctgtacacatttgctcacaatttatagtagttattttctatctacctatatttaaaattaggatgattaaaaaataatttatagattttgtgacagtaatgatttacatatgcccaatatatgccttatttttaaataagtcattctgtataaagtcattttgttgttgttcagagaaatcaagatcttattcacaaagaaaaacattttataaattgatcgcattttctttaagtcaaaatgttaaactggaggcagtattaaactttgcaattaggagtttcagagatgccttggcataccacgaaaaacactgtcaatatccaactcattataaattgttatcagaattaacctaataactttaagtaaggacaagcagcatcctagcaacttgtagtagtcttgggttcccagcagagtatcacagttaacctctctgacaacttcatcagaatttccaagctgccaaataatcttcatagacctaattacagatttaaaaaaatttcctaggcgacgaaagtatagaaatgtgaatatgatgaatacattgagaagctgtactttttaattagttatattacttctggaagcacatatctaaggaatattttctaagactcagagggaaaaaaactcgttttcataggatcatctgaagatactttagtatatttgtgatcatttttatctattgcaaatacaaatgaattagataagtgccacatcctggatacatttcggaggggtagtgggcaatggtatacaaaaataccaaatataaaattttcatctgggggaatgttcaggttctaaatactaaattagatttcaatgttttgtgtttttttaaaaaaaatcatattgcaacttgttttattgtgattttctacaagtattaaatacatttaaagatctttttatcttaccaagaaataatttggaatagcattggtatatttgaccttttgagtgtctgtcatcctcagagaatggcccatagtgtgttgcctgtggacatagtgtccatagtccctttcttgtccttctgagatattttggtttgataacattttgttttttgtcttgatgcacagggacttttttataatatgagacttcagttggtattaataggagttacctatttaattctcccagtcatcaatgaggtaatcatcaattcctatagttcaaattagtcataaacaagagctacagcaagactgatagagtaaaaactatataaatacagtaaaaaaaaatagaatttatggtgtgaaatatgaagtatagcaatatataacaagaacatgtaagcacttgcttccacagcataaatgtaatttacatctgcattaaaggataattttctctgtgaataagagcaaaatggtcttcagagaaacagactgttcatttgaagccatttctgtaaacatcttccaagatagaactgtaatggattgaggaaataacacagaaaagacaaaaacttttgatttcaggcatgcaaagtgcgtgggcagatggacagttcccattgtgcattgcctttgataaattgggccttaatttatataacgatgctgtgttcacatccctctcctacctaaagttgtctttattggtttatattgtgttaaaattagcttataattattacttttgtattgtgttcagttttttaagttgcatgtttatactatttgctacagtatttttaagtttggggtgaaggccatcagctgtatcaaaaagacaaaacaatcactatttattcagtattgctgctttacatctccagaataagctttcgatgccaggacagtgactgcctgaaagctgcaggagctcttttcaatgcattttatatatttttagaaaccaaataaatgcagaaaactatttagtatactaattatattaaaccagcagaaatataaaggcaataaagtatatacatatatatggggggaggggaaagattaaaaaatagatttacagccagacatggtgatagccctaaatgtatttctcaatatgtttttctttattgaccctaggaggatttgagttgctgcagctttaaacagaaaattgccatgttcactaattgtgagcacataaatatgcttttagtactgctttgcttatgtacaaataaatctgtaatatgtattatatgtaattatccttttctttgactttcattttaaatgtatattttctgatcattatgagctgtaaaacaaagaatcaatattggatattctcccaaataataaattttcaggattcattggggca

SEQ ID NO: 280096 - DNA, 3000 bp, Homo sapiens
gaggacacagctagaaggcaccatcactatcagcgaaccagaaagcaggctctcacccgacgctgagtctgacggtgacttgaccttggactttccagcttccagaaaactgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggccacagagcataacagatatttttcataagctaaattgtatgtataaaacatttgcagtgtttcagacactgttgaacaaaaatgtaattggtaagtatgtatccaaacaggcatggggtttcctgatacattatgtgttttgtttctgccctgtcttatcatttacactcatggatcttcagaattaatctaacatggaagttatagatacctgaaagctgggttggtctacttcaggaacattgctttaagtgatgtattttaaaataacccgcttcatatgtatgatctgttggtgtacacaccatgggtaaggtattgcttgcacataatttgctctgcatattatggaccattgtggtttcttccagtcacttagatggaaaggaggttaaacctaggtactttttagcaaggatataaagtcaaattcagcatatgtttttatttttaggcttgacttttacaagacattaatctccatttgtacatatgttattttatttgtaaaaccaaatatgactcaacacctttttgatgagtagtgacttaactaagatttacaagtaatatttagacagattcagtcagacaccacttagccatttttacattccctctggttagatttggtacagtataattaagactttaatctgaaatttaaagtagttttaattctgaagaagttacatcctctgtattatttacatgcaacaaaataaaagtggattaatatagtaatgccatggtaacaatagagcagcattgtcagcattcactaaaccaaagtcagtcaaatgtgttaaaacatccaaagttgccttcatgcataagacatagctctattggtcgacg

SEQ ID NO: 280097 - DNA, 1137 bp, Homo sapiens
ctggcggccgccatggcccccacgacgctgctctagggtcctccggggcgggcggggcagccgggcatggctctaaggggacgcgccccggggcccccggagggaggggggtccttagcgccgaacccccatgcgtgagtgggggacccggcggggggcgtcgagggtccgggcgtggggtagggcctcaggagcggcgggtcatgcaacggtggcgacaacggggcttcttcctcctccaccttctccacgtcccgcggggcaggggcgccggcagcgcctcatgccgcggagggctgctgcggagacgcggcccgactcccgaccagaccctcggacgcccggcccggcccgcactttaaagctctccgcacgacgtcacgggcagccagcccgacgtccgccagcgccgctccttagcgggctcctcaccgcgcacgcgcagtgctgccggccaccgcggctccgcgcgctacgggcatgcgcgtgcgtgcaggccgggtcggcagaggcgccggcgcaagcgcagacaggaaccgcttgccgtccgccgcccctcccccactctctgaggggcttcaagggaacgctctcaaatagcaacctgtcttcacgccgcgccgcctccaggaccgaagggctccctctacaggggtgcgctcatattgccaacagtgtcgccgtgccgcgtcacggcatcgtccgaacgcccgcagacgcctcaaccccagggcgcattcaccagggaaccgccacaacgtaggccgctccgttacctccccctttggcgcttccacttctttaattgggccgtgggccacgcgccgggcaggccctgactggagtttccggaagtcggttggtaatcatgcgtgtcaatcaggcagtctccttagctactgtgtccgtcacttaattagcggctgggcgagcagcgaggacccctaaaggagaaatgggtggttaaataagtgcctgaatggagactccacctgagtaaagcccttagaacgcctaaggaaacttctgaaacccgcgaaaacttctcagactgcgggacctgcagcacccggccccagttctgaacccagataggaacgtccggcagaagccagacgcgcgttgtcggggtacaag

SEQ ID NO: 280098 - DNA, 827 bp, Homo sapiens
ctggtgcacccactcggggatctcgtccacgtcgcccggcgggtagaggcgctcctggccgggcccgcgcttctgcagctgggcgccgtaagtgtagccttcgccgaagaagtacttgttgcgcagtggggcccggtccaccgtgtgctcgttgtacaggcccttctcagcgcgggacaccacctcgtcaatgcgggcctcgatcttggcgcactcgtcctggctgaagaggcgcatctggcggatgccgctcttcaccttgcgcgcctcctcctccttctgcagctgctgctcctcatagtcgctgcgctcggggtccgagtcctcctgatacttgcgcttggccccggacacagggtaaggttcggcggcagcggcggctgcggctgcggcggctacggcggctgcggcagcggcggcggcctcccggctgcccgccttatagttgtcccgggacgtcatggacttgagcttctcacgcaggtccttagcgccgaacccccatgcgtgagtgggggacccggcggggggcgtcgagggtccgggcgtggggtagggcctcaggagcggcgggtcatgcaacggtggcgacaacggggcttcttcctcctccaccttctccacgtcccgcggggcaggggcgccggcagcgcctcatgccgcggagggctgctgcggagacgcggcccgactcccgaccagaccctcggacgcccggcccggcccgcactttaaagctctccgcacgacgtcacgggcagccgggcatggctctaaggggacgcgccccggggcccccggagggaggggggtccttagcgccgaac

SEQ ID NO: 280099 - DNA, 1089 bp, Homo sapiens
aatatattagatttggtttttattgtagagcacacatatcagggcgaagtgctgcacacacaactacaaatcatttttgggaaaaaagctgtaaaaaaaataaaactgcaactgctttaattatgcagtcccgacttgagaaatccacgctggcaaaggagttctggcccctgagagggttcttcctcctccaccttctccacgtcccgcggggcaggggcgccggcagcgcctcatgccgcggagggctgctgcggagacgcggcccgactcccgaccagaccctcggacgcccggcccggcccgcactttaaagctctccgcacgacgtcacgggcagccagcccgacgtccgccagcgccgctccttagcgggctcctcaccgcgcacgcgcagtgctgccggccaccgcggctccgcgcgctacgggcatgcgcgtgcgtgcaggccgggtcggcagaggcgccggcgcaagcgcagacaggaaccgcttgccgtccgccgcccctcccccactctctgaggggcttcaagggaacgctctcaaatagcaacctgtcttcacgccgcgccgcctccaggaccgaagggctccctctacaggggtgcgctcatattgccaacagtgtcgccgtgccgcgtcacggcatcgtccgaacgcccgcagacgcctcaaccccagggcgcattcaccagggaaccgccacaacgtaggccgctccgttacctccccctttggcgcttccacttctttaattgggccgtgggccacgcgccgggcaggccctgactggagtttccggaagtcggttggtaatcatgcgtgtcaatcaggcagtctccttagctactgtgtccgtcacttaattagcggctgggcgagcagcgaggacccctaaaggagaaatgggtggttaaataagtgcctgaatggagactccacctgagtaaagcccttagaacgcctaaggaaacttctgaaacccgcgaaaacttctcagactgcgggacctgcagcacccggccccagttctgaacccagataggaacgtccggcagaagccagacgcgcgttgtcggggtacaag

SEQ ID NO: 280100 - DNA, 1642 bp, Homo sapiens
ctggcggccgccatggcccccacgacgctgctctagggtcctccggggcgggcggggcagccgggcatggctctaaggggacgcgccccggggcccccggagggaggggggtccttagcgccgaacccccatgcgtgagtgggggacccggcggggggcgtcgagggtccgggcgtggggtagggcctcaggagcggcgggtcatgcaacggtggcgacaacggggcttcttcctcctccaccttctccacgtcccgcggggcaggggcgccggcagcgcctcatgccgcggagggctgctgcggagacgcggcccgactcccgaccagaccctcggacgcccggcccggcccgcactttaaagctctccgcacgacgtcacgggcagccagcccgacgtccgccagcgccgctccttagcgggctcctgttcgacagtcagccgcatcttcttttggcctcgccagccgagccacatcgctcagacaccatgggaaggtgaaggtggagtcaacggatttggtcgtattggccctggtcaccagggctgacttttaacttggtaaagtggatattgttgccatcaatgacccttcattgacctagtaagttcaattgatcacatcgaatcatgcactgcaatgctgagacggaagcttgcatcaatgaataccatcacatctcaagacagatcctcaaatcaagtggcgatcgtggcctgagtacgtcgtgagtccactgcgtccttcaccaccatggagaaggctgggctcatttgcagggggagccaaaaggtcatcatctctgccccctctgctgtagccccctagttcgtcatgggtgtgaaccatgagaagtatgacaacagcctcaagatcatcagcaatgcctcctgcaccaccaactgcttagcaccctggccaaggtcatccatgacaactttggtatcgtgaaggactcatgaccacagtccatgccatcactgccacccagaagactgtggatggccctccgggaaactgtggcgtgatggcgcggggctctccagaactacatccctgcctctactggtcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagctgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccacctgaatctcccctcctcacagttgccatgtagaccccttgaagaggggaggggcctagggagccgcaccttatcatgtaccatcaataaagtaccctgtgctcaacc

SEQ ID NO: 280101 - DNA, 856 bp, Homo sapiens
ctggtgcacccactcggggatctcgtccacgtcgcccggcgggtagaggcgctcctggccgggcccgcgcttctgcagctgggcgccgtaagtgtagccttcgccgaagaagtacttgttgcgcagtggggcccggtccaccgtgtgctcgttgtacaggcccttctcagcgcgggacaccacctcgtcaatgcgggcctcgatcttggcgcactcgtcctggctgaagaggcgcatctggcggatgccgctcttcaccttgcgcgcctcctcctccttctgcagctgctgctcctcatagtcgctgcgctcggggtccgagtcctcctgatacttgcgcttggccccggacacaggatggagtttcgctctgtcgccaggctggagtgcaatggcgcgatctcggctcactgcaacctccgcctcccaggtttaagcgattctcctgcctcagcctcccgagtagctgagactacaggcatgcaccaccacgcccagctaatttttgtatttttagtagagacggggtttcaccatgttggctaggatggtctccatctcttgacctcatgatctgcccacctcggcctcccaaagtgctgggattacaggcatgagccaccgcgcccggccacgtgtaaattctttagatttaaaaaatatgaatccaatcaataaatggtaacagtttctaactgtctgttgccatggttaccgcctggctcccacagtgcacaatgggcagtgacccaggcttagtgctcccaattggagcagggtaggggaaggcatcagggaattgcggaaatcaatctgtgaatgtggttctcagacgaaagccattgttggaatcccc

SEQ ID NO: 280102 - DNA, 492 bp, Homo sapiens
atagctcgctgcagccttgaactccggtgtttaagtagtcttcctgcctcagcctctcaaatcactgggaccataggcgtgagccactgctttcttcaaaatttgacccagaatccaatcaagggtgacagtgatcatcagacctacaaaatgaaggaatcttaagaaagatggcttaacccagtcagaagggacaagcataattttcttccatggctatttaaagccaactgggagccgggatgggaaactactaaagtttgatgcaccagactttggcctgatgcgctctcagcaaaatgtacagaggagatggccacttggtctttgggagcccctggctctctctttttaatgacactagctgctcttagcgcccactacaggaaatgaagcaatggaagaagcgcacctcatgtgaaagcatttggattttgctaggctattttctgagtagtatttgtcccgtggaaaaatacagaagaggaaatg

SEQ ID NO: 280103 - DNA, 282 bp, Homo sapiens
tagagaggaaagtaaagcgtttttttttccttgatacaagtatgaagcaggtgggacaacaggtttaagtatcagctttttctccagtgttagctagagtccaagatgagcccctgcctcaggaagcctagaaggagccacttttcatatagaaagtgtcacagggagggaagttggtaaaggtgataagggtgtgaggtcagttcctggtggtcccagtaggagctcagttctgacaatggcatgttgcccctccctcttcctcctctgctcttcagatga

SEQ ID NO: 280104 - DNA, 481 bp, Homo sapiens
tcccctttgtctgttggtccggcccagatcccagaccacctcctcgtccactcactgaccgccttctcccccggccagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatgacggctggcagcagcggcctctcctgtaaaa

SEQ ID NO: 280105 - DNA, 1556 bp, Homo sapiens
caggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgccctcaccaaggagcagctctatcagcaggccatggaagaggccgcctggcaccacatgcctcacccctctgactctgagcgtattcggcagtaccttccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcaggtgagggccccgccctctcttcccgctgctagggttggggtagagtccccaggctccaggcagcccctgctggcctctgctcccttgcctccacctttcagctggcgcagtccctcagcctgaccaagtactcctccctctggctgtctgctcagcctggaacaccgccctctcatcctccacttggccagctcctaggcctcctgtaggtctcagcccaaatgtcccttcctcaaagaaaccttcctggagccacccagcccagtgcctcccctttgcagtgctgggcacactcgcttggggtgtgggattttcccagtatgtgtccctgcaccaggctgtgggctctgctgccgagggaccttgatggcccccacttcacctccaggtcccagcactcagcagggcaggggctcagtgcggaaactattttttttgaatgggcttctcaagttctaatactgggaaattcctgctgcttgcaaacactctggaaccaacctacctgggtttcagcccagtccagctgggcgactctaggcaagtcactcgaacctctgtgtctcaattaacttatctgtaaaaatggggggaagaccacctacctaatgcagttgttatgaagattaaatgagttaataacatgtaagtacttaatggtgactgctacatagtcagtgtcatggattttttttttcaaattactttcagttggtgtgttctacagtgatgtttttttccaccaaatacttccctgatgccgagccccttcatggggatgaagtagtacaaggtccttgtcctcagagaactcagtcccctctcctgggttctcccagggttgccatctttgaagcacttaaggacattcatttagaacctaggtcctctcccattgtgtcctcagatgttaaccacagacttcctgtcctttcctggtttggcccaaaaccatcctccaagttagtacatttcagggcatccagtcattcagaa

SEQ ID NO: 280106 - DNA, 963 bp, Homo sapiens
caggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgccctcaccaaggagcagctctatcagcaggccatggaagaggccgcctggcaccacatgcctcacccctctgactctgagcgtattcggcagtaccttccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatgacggctggcagcagcggcctctcctgtaaaa

SEQ ID NO: 280107 - DNA, 387 bp, Homo sapiens
gggtagattgtggggagtgggtcgttggccctccacggcccccaaacagggcaggtgagagcatctggggcctgtgtcaggctgcacttgctcctgcagcccaagtgctcaggccaggcctcttgtttcctccccaggcccctgagcctctgagctccttgaagtccatggcggaacgggcagccatcagctctggcattgaggaccctgtgccaacgctgcacctgaccgagcgaggtgagggacccaggatggtggggaagcagcgggccaaagaggaggggctgcccctgacccatcctcaccactgagggggccggacccccaccctccccacagacatcatcctgagcagtacatcagcacctccggcctcagcccagccgc

SEQ ID NO: 280108 - DNA, 383 bp, Homo sapiens
ggacccaggtgagtggtctcacaggcatgggaggcccaggttgggcctgggtgttcacctccttgagacctccagaggacttctgtttgagggagacgttactgatccagctggtcctcatgttccttactgacttcacaggtgagcattgtgttttggaaggaacatgcagggattgttgcctgcccgcctttctgtctttttttcttttcttttctttcttcttcttcttcttttttttttttttttttaaaggaaattggcagcacttttcttggagcaaggctcagtcttagggaagtcacaagctactacccagggagcaggccaacagaagatactctcctctattctaagattcctccagtacatactttagattc

SEQ ID NO: 280109 - DNA, 249 bp, Homo sapiens
ctttcttcctctacacacatctgctctgacagctttcctccaggcgtctcatcacagcaatactgaaagggactgtggcaagccagttttgggacccgtcctccaggaaaaagaagtgggaggtgagtctcaacagtgaatgactggaaacaagagcttataaaactgcttttgggtgtgttcccagtggacagaagaaaacaagaataagaatctttaaaaatcatgattaaaggtctttcgtgtaac

SEQ ID NO: 280110 - DNA, 1014 bp, Homo sapiens
gtctccgcggaaggcaggcgccggggagtggggcgcgggcgaccgtgtgcagccgcggcgcatctccgccttccgctcctcctcgcagcgccctcgtccgcttccaagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagagcgctcacttctcagaggatcgcattccgaggaccgcgcgaggaagggacgtcgcggcgccaccacttcctggctggactccgctgacatctgtagcctcctttccaccaggttcccggggctcccagccgctgcctgcagaggagcgtgtagacagcgcgcgagggtccggcacttcgtggacctccatccgaaccggagttctgcccggatcccgagtccctggatcccggtggagcccgccggcaagctggctccggagggagttgaacttgagttcagatggccaactccctctgaatcctgcagattggtgctgagcacgcaacaaaagtttgtagcttctcagtttctggtgcttcgcaggggagaggaaaggaatttgacattaaacacaagaagcagtcagggagccatctcctttaacttttcttctctgttaccatttgcaatgaagaggaaacagaagagatttctgcagatgactttgttgttcacggtggctttaattttcctgcctaacgttggtctctggtctctgtacaaggataagcacctggtgaagtcagcggagcccggggagcagcaggtaagtgccacccagagaaagatcacagaaggatggtaaggcagtgatcctcgcgcggggactcgagaaagccggtgtgggatcgccttgggttttcccccaagtcttgacagagctgattattacaagactcta

SEQ ID NO: 280111 - DNA, 951 bp, Homo sapiens
  misc_feature (944)..(944): n is a, c, g, or t
gtctccgcggaaggcaggcgccggggagtggggcgcgggcgaccgtgtgcagccgcggcgcatctccgccttccgctcctcctcgcagcgccctcgtccgcttccaagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagagcgctcacttctcagaggatcgcattccgaggaccgcgcgaggaagggacgtcgcggcgccaccacttcctggctggactccgctgacatctgtagcctcctttccaccaggttcccggggctcccagccgctgcctgcagaggagcgtgtagacagcgcgcgagggtccggcacttcgtggacctccatccgaaccggagttctgcccggatcccgagtccctggatcccggtggagcccgccggcaagctggctccggagggagttgaacttgagttcagatggccaactccctctgaatcctgcagattggtgctgagcacgcaacaaaagtttgtagcttctcagtttctggtgcttcgcaggggagaggaaaggaatttgacattaaacacaagaagcagtcagggagccatctcctttaacttttcttctctgttaccatttgcaatgaagaggaaacagaagagatttctgcagatgactttgttgttcacggtggctttaattttcctgcctaacgttggtctctggtctctgtacaaggataagcacctggtgaagtcagcggagcccggggagcagcagacattttccactgggcctgggagatgggcaatctattcatggacagatggtttgagaagaaaggnttgcatg

SEQ ID NO: 280112 - DNA, 1239 bp, Homo sapiens
gtctccgcggaaggcaggcgccggggagtggggcgcgggcgaccgtgtgcagccgcggcgcatctccgccttccgctcctcctcgcagcgccctcgtccgcttccaagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagagcgctcacttctcagaggatcgcattccgaggaccgcgcgaggaagggacgtcgcggcgccaccacttcctggctggactccgctgacatctgtagcctcctttccaccaggttcccggggctcccagccgctgcctgcagaggagcgtgtagacagcgcgcgagggtccggcacttcgtggacctccatccgaaccggagttctgcccggatcccgagtccctggatcccggtggagcccgccggcaagctggctccggagggagttgaacttgagttcagatggccaactccctctgaatcctgcagattggtgctgagcacgcaacaaaagtttgtagcttctcagtttctggtgcttcgcaggggagaggaaaggaatttgacattaaacacaagaagcagtcagggagccatctcctttaacttttcttctctgttaccatttgcaatgaagaggaaacagaagagatttctgcagatgactttgttgttcacggtggctttaattttcctgcctaacgttggtctctggtctctgtacaaggataagcacctggtgaagtcagcggagcccggggagcagcaggaattcaactttggtttgaagtatattctgttttgtcattccagtgaaaaaaagaagatggacactttggatgtgaaactttttttgttcttatttacatcattcaacccttgatgtaaaacaggattttaataactttagtagtcaatatgctattatgtaaaatctccactccatgctggtaaaacaggaaaggcaaaattattttttcttgaaatttgctaattcaattaacaataaccatctgaagtatttgctggtatagctaacataaagcgctaattaattttattaatgagattcttacaactttcacattgactctataattttgacccttaatgagaaaattgtttgtct

SEQ ID NO: 280113 - DNA, 282 bp, Homo sapiens
cggaagaaatggggacccggcaggcggtgacggaggcggcacgcgcggagatggatactgggccagccacgaaagcctccgccccctcgaagcgggctccctcgccgccaactctagtgaagaagcagcccttctccccggcgcccgctggtttgcagaggcctgctatgaagagcttgtgcaagtaaagcgtttgctgagcggaaacaggctgcgggtggctgcggcaggcatggagccgacgcggatcttttgcaaacatctttattaatctcatataaa

SEQ ID NO: 280114 - DNA, 1690 bp, Homo sapiens
  misc_feature (798)..(798): n is a, c, g, or t
ctctatccccagcagaggcagcggagaagacaaggccgggaggcaccgggctaggctgcgcaccaggcccaggcctgtccctcgggaccgcgcgtgccgcctgaatccgctcccccgtcgggcccggtccagctggcgcggcggccaccctcacctggatgacctcgttgacctcccggatacattccaccatgtgttgtagaatctgctcggccgtgagcacctcgtagcggtaatcctcctcctgctcatgccccggcccgccaccaccaccgccgccgccgccgccgccgccaccgccgggccccagagcgctgccgccgccaccgcccgtctccccgcacagcagtccgtcccgctccccgccgacgcccagcccgggctccaccagctccacctcgcccagatccagggtatcatcgtccggctcgtcgtcgtcttcgtcctcctcctcctcggcgccgctgtcctcctcactgcactcctcgtcctcgtcgaactcgtagttgtagccctcgtccgagtccatggcgcgacgcgcgggggcccggcggacgctggccgaggcggggagagggcggggacgccgaggccccggctctcgctccggctccggctgatgtccggacgcaggcctggctccggccccgcgagccgcggctcctccccaggagcggcggttggcgtttgacggctggtggcggcggggagggcgcggaggagggagggagggagcgagggggccgcttgctgcccgcctcagtcagacgcggctccgctccggcctccgagagaaancagtccccaacgccacctccacggccgctgctatcgctactgagccaacaaaggggcgtgcgtcaccgcgtcgcgctgcgtcgtcgcgtcactcctctttgcgtcactgcgccccgccccaccgcccctgcgtggagcccggggagaccccacggcccggccttcctgggcctgggacccgaggggagccgagcgggaattgctttcctggttcgatccgctgccgctgtgagggccgagcggaaacccgtagaccttttatgtgaagagattgcggcctcctggtcaccagtcaccgagagagggacccctggaccgcctacgtggtggtgtctgccgcaggccatagggatccagcccacttaggcagtcccttggggacgcggccttccctccggagcggaaaggcgcttcccgcccgccctgcggtaatcccggaagccctcagccgttaagctaaaatttctgttgctttggctactgatggaaacctgttgtaagtggaacctctaaactgtatgacaggtgaacccactttaggtagctgtgtgattctgtccacttgtacagacgtgcagtggtttttaagtctcctataatgacgtcattttaaagaggcatttcctccaccccgctgacaagagcgcctcttgagggccctaaacaatgtaaacagcgatgattttcatgaattgagcactgtgtaagggctttacatatattctgtctcatcttcacggagccatagtacccattttatacctgaggaacctgaagctcagaaaggaaaagggacctggccaagaccacataacccttgccctattttaaccgctggatgccccaaaacatgaatcataaaaatgctttgtaatgtagatatattatgtac

SEQ ID NO: 280115 - DNA, 1682 bp, Homo sapiens
  misc_feature (798)..(798): n is a, c, g, or t
ctctatccccagcagaggcagcggagaagacaaggccgggaggcaccgggctaggctgcgcaccaggcccaggcctgtccctcgggaccgcgcgtgccgcctgaatccgctcccccgtcgggcccggtccagctggcgcggcggccaccctcacctggatgacctcgttgacctcccggatacattccaccatgtgttgtagaatctgctcggccgtgagcacctcgtagcggtaatcctcctcctgctcatgccccggcccgccaccaccaccgccgccgccgccgccgccgccaccgccgggccccagagcgctgccgccgccaccgcccgtctccccgcacagcagtccgtcccgctccccgccgacgcccagcccgggctccaccagctccacctcgcccagatccagggtatcatcgtccggctcgtcgtcgtcttcgtcctcctcctcctcggcgccgctgtcctcctcactgcactcctcgtcctcgtcgaactcgtagttgtagccctcgtccgagtccatggcgcgacgcgcgggggcccggcggacgctggccgaggcggggagagggcggggacgccgaggccccggctctcgctccggctccggctgatgtccggacgcaggcctggctccggccccgcgagccgcggctcctccccaggagcggcggttggcgtttgacggctggtggcggcggggagggcgcggaggagggagggagggagcgagggggccgcttgctgcccgcctcagtcagacgcggctccgctccggcctccgagagaaancagtccccaacgccacctccacggccgctgctatcgctactgagccaacaaaggggcgtgcgtcaccgcgtcgcgctgcgtcgtcgcgtcactcctctttgcgtcactgcgccccgccccaccgcccctgcgtggagcccggggagaccccacggcccggccttcctgggcctgggacccgaggggagccgagcgggaattgctttcctggttcgatccgctgccgctgtgagggccgagcggaaacccgtagaccttttatgtgaagagattgcggcctcctggtcaccagtcaccgagagagggacccctggaccgcctacgtggtggtgtctgccgcaggccatagggatccagcccacttaggcagtcccttggggacgcggccttccctccggagcggaaaggcgcttcccgcccgccctgcggtaatcccggaagccctcagccgttaagctaaaatttctgttgctttggctactgatggaaacctgttgtctgcagatcaaagtttggctgatcttggctgggcttgtctatgtttggctgggctaggctggactccaatcttcaggtcaggtttacatctgcttcacatgtcttcatcattctagaacaagttgcctgcctgagatacattcttcccacagtgggggacagaagtacaagagagacaaaggcccagaaacagcctgaagagcctctgaactaaggccacttgaagcaaggaggcacaagtaattctgccataacgaaactcacctgattggaagaggggcgtgaagaaagggttttctaaggcaggatcaaaatgagagattccatctcagaccttggcccttcatctttagcaggtgatactgtagtcaccggaccaaccccca

SEQ ID NO: 280116 - DNA, 1549 bp, Homo sapiens
  misc_feature (798)..(798): n is a, c, g, or t
ctctatccccagcagaggcagcggagaagacaaggccgggaggcaccgggctaggctgcgcaccaggcccaggcctgtccctcgggaccgcgcgtgccgcctgaatccgctcccccgtcgggcccggtccagctggcgcggcggccaccctcacctggatgacctcgttgacctcccggatacattccaccatgtgttgtagaatctgctcggccgtgagcacctcgtagcggtaatcctcctcctgctcatgccccggcccgccaccaccaccgccgccgccgccgccgccgccaccgccgggccccagagcgctgccgccgccaccgcccgtctccccgcacagcagtccgtcccgctccccgccgacgcccagcccgggctccaccagctccacctcgcccagatccagggtatcatcgtccggctcgtcgtcgtcttcgtcctcctcctcctcggcgccgctgtcctcctcactgcactcctcgtcctcgtcgaactcgtagttgtagccctcgtccgagtccatggcgcgacgcgcgggggcccggcggacgctggccgaggcggggagagggcggggacgccgaggccccggctctcgctccggctccggctgatgtccggacgcaggcctggctccggccccgcgagccgcggctcctccccaggagcggcggttggcgtttgacggctggtggcggcggggagggcgcggaggagggagggagggagcgagggggccgcttgctgcccgcctcagtcagacgcggctccgctccggcctccgagagaaancagtccccaacgccacctccacggccgctgctatcgctactgagccaacaaaggggcgtgcgtcaccgcgtcgcgctgcgtcgtcgcgtcactcctctttgcgtcactgcgccccgccccaccgcccctgcgtggagcccggggagaccccacggcccggccttcctgggcctgggacccgaggggagccgagcgggaattgctttcctggttcgatccgctgccgctgtgagggccgagcggaaacccgtagaccttttatgtgaagagattgcggcctcctggtcaccagtcaccgagagagggacccctggaccgcctacgtggtggtgtctgccgcaggccatagggatccagcccacttaggcagtcccttggggacgcggccttccctccggagcggaaaggcgcttcccgcccgccctgcggtaatcccggaagccctcagccgttaagctaaaatttctgttgctttggctactgatggaaacctgttgtgttcatgaggtcttcatggttgtgcgaggcataagaaagagagggtatgatatgcctgtttagcatggccctcccaatctagagtttgtctagggcttaggctcgttttacctaccacatcaacagtggtcaggcatcatttcatgcttcatggcgtcatggtatcaagggtgcgggccacctactttgcaccccaagggtgctattcggtttggctatgaatgaattaaggtctccaacagtgggcgaaaaa

SEQ ID NO: 280117 - DNA, 2248 bp, Homo sapiens
ccacccccggccccgaagctccgccacccgccgccatgagtagctttggagctggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280118 - DNA, 2859 bp, Homo sapiens
ggcgcagccaatcctggccctaggattgtgttggggggcttggcaggcggtgtcccgacccccctttctgggcatcctggggatgaccccagcgccgggcccggcgccggccgcctgatgccaggcgagctgagctggggatgctggaacgaagggcgttgctatggcaacgggaggcagggcctggttggggggaccgggcccgggctgggaccgggggggccggcggtggctgtggtggggcgatggcggagcgcggccggccttctgcggcctgtacgacacgtcctcgctgctgcgatactgcaacgatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatcttgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280119 - DNA, 2820 bp, Homo sapiens
ggcgcagccaatcctggccctaggattgtgttggggggcttggcaggcggtgtcccgacccccctttctgggcatcctggggatgaccccagcgccgggcccggcgccggccgcctgatgccaggcgagctgagctggggatgctggaacgaagggcgttgctatggcaacgggaggcagggcctggttggggggaccgggcccgggctgggaccgggggggccggcggtggctgtggtggggcgatggcggagcgcggccggccttctgcggcctgtacgacacgtcctcgctgctgcgatactgcaacgatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280120 - DNA, 2796 bp, Homo sapiens
agtgtgggactggaaagggacggccagaggactttgcttctaggatacctcccaaatcctctggccctggccctcccatgcattagcaccatcccttctccctagacaaatgggtgtgataccagaaggaccactgtgggtgtcgggctcagatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280121 - DNA, 2310 bp, Homo sapiens
ccacccccggccccgaagctccgccacccgccgccatgagtagctttggagctgggtgagaccctttcgcagaccaccccccatctcctctccgcgctcccggggcttagatctcagcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280122 - DNA, 2565 bp, Homo sapiens
ggcgcagccaatcctggccctaggattgtgttggggggcttggcaggcggtgtcccgacccccctttctgggcatcctggggatgaccccagcgccgggcccggcgccggccgcctgatgccaggcgagctgagctggggatgctggaacgaagggcgttgctatggcaacgggaggcagggcctggttggggggaccgggcccgggctgggaccgggggggccggcggtggctgtggtggggcgatggcggagcgcggccggccttctgcggcctgtacgacacgtcctcgctgctgcgatactgcaacgatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280123 - DNA, 1934 bp, Homo sapiens
ggcgcttcgttgttattagtggccactagtcatacaatcttcaagtgtggcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280124 - DNA, 2688 bp, Homo sapiens
ggcgcagccaatcctggccctaggattgtgttggggggcttggcaggcggtgtcccgacccccctttctgggcatcctggggatgaccccagcgccgggcccggcgccggccgcctgatgccaggcgagctgagctggggatgctggaacgaagggcgttgctatggcaacgggaggcagggcctggttggggggaccgggcccgggctgggaccgggggggccggcggtggctgtggtggggcgatggcggagcgcggccggccttctgcggcctgtacgacacgtcctcgctgctgcgatactgcaacgatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280125 - DNA, 3166 bp, Homo sapiens
ggcgcagccaatcctggccctaggattgtgttggggggcttggcaggcggtgtcccgacccccctttctgggcatcctggggatgaccccagcgccgggcccggcgccggccgcctgatgccaggcgagctgagctggggatgctggaacgaagggcgttgctatggcaacgggaggcagggcctggttggggggaccgggcccgggctgggaccgggggggccggcggtggctgtggtggggcgatggcggagcgcggccggccttctgcggcctgtacgacacgtcctcgctgctgcgatactgcaacgatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtacttagagatggggtttcaccatcttggccaggctggtctcgaactcctgacctcaggtgatccagccagatgctgtggctcatgctgcctcctgggattacagacgtgagccaccatgcccggccagatgcgggtttaaaagtagatgctcctgcttacgctgcgggctgtgaagaccccagcatgtgatgccttctcagccagtcctgacaggggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280126 - DNA, 1662 bp, Homo sapiens
aggctaggtagcgggctgggtgtgaatcggccgaggtcgcccgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatcttgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280127 - DNA, 1057 bp, Homo sapiens
gctggagggcaatggcacgatctcggctcactgcaacctccgcctcccgggttcaagtgattcttctgcctcagcctcccgagtagctgggattacaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280128 - DNA, 724 bp, Homo sapiens
gcggccgcctactactactaaattcgcggccgcgtcgaccccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280129 - DNA, 1463 bp, Homo sapiens
ggcgcagccaatcctggccctaggattgtgttggggggcttggcaggcggtgtcccgacccccctttctgggcatcctggggatgaccccagcgccgggcccggcgccggccgcctgatgccaggcgagctgagctggggatgctggaacgaagggcgttgctatggcaacgggaggcagggcctggttggggggaccgggcccgggctgggaccgggggggccggcggtggctgtggtggggcgatggcggagcgcggccggccttctgcggcctgtacgacacgtcctcgctgctgcgatactgcaacgatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcagtcgacgcgggcgggaatttagttgaagtaggcgacccgggaatttcggaccgg

SEQ ID NO: 280130 - DNA, 417 bp, Homo sapiens
taaatttgttttgtttaagagacagggtctccctatattgcctatgctggcctcaaactcctggactcaagcgatcctcccacctactgtgcccagcctgaaggttttaaaacaggcctgtgtggtgaatgccttggtgggcatggggggaggatgggccctgactccccttgcctctgtccccctcctctctcctcctctttagaatggaggcaacctgctgtgtgcagtggatgaatccaatgatcacatgctctcggtgtgggactgggccaaggagaccaaggtggtggatgtcaaggtgaggtgacttttctcatcccctcctgctgggtgccactgtgggactttcccaatctcagtggttaggagtctgcaatcagatagacccgtgtttaagccctggctttactcctt

SEQ ID NO: 280131 - DNA, 558 bp, Homo sapiens
cacggtcctgggtgacagatgacctctgggaggctacctgcttcagtgacgctctgacaccttcctttcctcccccaccttagaaacatgagaaaccgaagtatgtgctgtgtgtgacctttttggaaggtggcgacgtggtcacgggggactctggggggaacctctatgtttggggcaaaggtcagtgtcaccccatctgtttggttcccaatccagtcttctgaaacactcctggctctgcctcccttcgtggaattctgcttgtgtgaaatgagtgtaaatggatgtccgattccaacaccctcgtcaaggttcagctcaagtatccctatctccaggaaatctttattgactcccccctgccttgccctctggaaatcccttgttagggatcaagtccagattatcaatgaatgggttagctcagttgtgtttagatgatgaatggatggatgggtggatggaaggaaggacggatgggtagatgaatggatacatggacaagtgctttgtcccagcgtgtggatcaatgaataagtgaatgaaggaatgaat

SEQ ID NO: 280132 - DNA, 1968 bp, Homo sapiens
ccacccccggccccgaagctccgccacccgccgccatgagtagctttggagctggcaaaaccaaagaagttatcttcagtgtggcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280133 - DNA, 2955 bp, Homo sapiens
ggcgcagccaatcctggccctaggattgtgttggggggcttggcaggcggtgtcccgacccccctttctgggcatcctggggatgaccccagcgccgggcccggcgccggccgcctgatgccaggcgagctgagctggggatgctggaacgaagggcgttgctatggcaacgggaggcagggcctggttggggggaccgggcccgggctgggaccgggggggccggcggtggctgtggtggggcgatggcggagcgcggccggccttctgcggcctgtacgacacgtcctcgctgctgcgatactgcaacgatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280134 - DNA, 3053 bp, Homo sapiens
ggcgcagccaatcctggccctaggattgtgttggggggcttggcaggcggtgtcccgacccccctttctgggcatcctggggatgaccccagcgccgggcccggcgccggccgcctgatgccaggcgagctgagctggggatgctggaacgaagggcgttgctatggcaacgggaggcagggcctggttggggggaccgggcccgggctgggaccgggggggccggcggtggctgtggtggggcgatggcggagcgcggccggccttctgcggcctgtacgacacgtcctcgctgctgcgatactgcaacgatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaaggctggagtgcaatggcataatcttggctcactgcaacctccacctcccaggttccagcgattctcctgactcagcctcctgagtagctgagactacagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280135 - DNA, 2675 bp, Homo sapiens
aagctggtactggtctggagttttagggatcatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280136 - DNA, 3421 bp, Homo sapiens
ggcgcagccaatcctggccctaggattgtgttggggggcttggcaggcggtgtcccgacccccctttctgggcatcctggggatgaccccagcgccgggcccggcgccggccgcctgatgccaggcgagctgagctggggatgctggaacgaagggcgttgctatggcaacgggaggcagggcctggttggggggaccgggcccgggctgggaccgggggggccggcggtggctgtggtggggcgatggcggagcgcggccggccttctgcggcctgtacgacacgtcctcgctgctgcgatactgcaacgatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaaaaaaaaaaaaaaaaaaaaaaaaaaaaaaaaaaaaaaaaaaaaaaagagggggggggggcgaaaaaaaattcccgggggggggggcccagagtttgggggcgaccgagttttttgtgtaaagaggggggccccaaaagggggggtaaaaaaaaaggagaggggggggggcgcggcggattaaaacaacgggcgggagaggaggggggaaacacacgtgctagacggggggaactctggggagagggacccccacatccggcgggggggggcaaacaatgggggacacaacacaccccaccagaagattataaacggcgccagaggagaaaaagataaacagtgcgaggcgcatatcggggggtcagacccgcgagcggcaataatgtgcgccgggcaagaaaaatattgccacacacgagggataggagctgaggaaaaattaacagggcagagagtgaacagagga

SEQ ID NO: 280137 - DNA, 2216 bp, Homo sapiens
atcagctcggtaccggattgacgccacgtaaagaagttatctctcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280138 - DNA, 1794 bp, Homo sapiens
aggctaggtagcgggctgggtgtgaatcggccgaggtcgcccgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatcttgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280139 - DNA, 2857 bp, Homo sapiens
ggcgcagccaatcctggccctaggattgtgttggggggcttggcaggcggtgtcccgacccccctttctgggcatcctggggatgaccccagcgccgggcccggcgccggccgcctgatgccaggcgagctgagctggggatgctggaacgaagggcgttgctatggcaacgggaggcagggcctggttggggggaccgggcccgggctgggaccgggggggccggcggtggctgtggtggggcgatggcggagcgcggccggccttctgcggcctgtacgacacgtcctcgctgctgcgatactgcaacgatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280140 - DNA, 1396 bp, Homo sapiens
agggtgcagcctgtctgacccctgagatcaagctctgagccaccatgccctcctgcctcccattgtgcaaagaagaaagcagaggtccctggagaaggggcaggatttgccttgagtcacacaccagggcatgggttcagatgcccaattgaggcccccttcagacatactgggaaaggtcttccctgggtcccgctggggcagggtgagttgctggggctcatctagcatttgtctggcattagtgttgagtgggaaaaggccagggctgctgtctccatcctgctgtcctccctttccaccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280141 - DNA, 1232 bp, Homo sapiens
ataaacatgcatcatgtctgtgccctcatggtgtccctttgtcttcttgtcaaaacactcatccttatgtccctcttgagtttaaatgtctttctctcatcctcttctcctcagccccattccccttttctcagggtggtgatcacaggacaccatgctgattgaattgactcataatcccagagtcccactttttaaaaaggagatatttactctctctcccactcacgttggtgcaatctcagccctatgtcttaaatgcaggatttccagcagtaagagggaggcatgatttggttggagagaacttctatcactcactcaactacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280142 - DNA, 741 bp, Homo sapiens
tgctagacgcaacgtcaagccattgagggagggctttggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 280143 - DNA, 1922 bp, Homo sapiens
ggcgcagccaatcctggccctaggattgtgttggggggcttggcaggcggtgtcccgacccccctttctgggcatcctggggatgaccccagcgccgggcccggcgccggccgcctgatgccaggcgagctgagctggggatgctggaacgaagggcgttgctatggcaacgggaggcagggcctggttggggggaccgggcccgggctgggaccgggggggccggcggtggctgtggtggggcgatggcggagcgcggccggccttctgcggcctgtacgacacgtcctcgctgctgcgatactgcaacgatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccaggcctgcctccggtgctccctcccgccgtgcctccctccctcgctcggtcctccgtagctcctactggcggaaatctcagcaggccctttgttttctgttccccacagcctgggccggctcctgccctcacatatgctccggcacaagctgcaggactgccccctccccctcggcagtgtacacatttactctc

SEQ ID NO: 280144 - DNA, 133 bp, Homo sapiens
agacgggtgacaaggtgagcacacacaagcagacggaaacgtgggcctctgtgcttctcaagtttcttttatgagaaacgtatgctcaaataacctatcatctggcaaaactgaacaccgattatatgacgtt

SEQ ID NO: 280145 - DNA, 1856 bp, Homo sapiens
tcagattctcaatcttgcttgaagactgacaagatgtccctgtggactcccaaactctactccagatggggaggtgcccttaacaccaagattttaaaagctccaatttcagagcaagagtcgaaaactcacagataaagttatagttatttcagggttctgaaaagacgcagaacatgaagggactcagaagtctggcagcaacaaccttggctcttttcctggtgtttgttttcctgggaaactccagctgcgctccgcagagactgttggagagaaggaactggactcctcaagctatgctctacctgaaaggggcacagggtcgccgcttcatctccgaccagagccggagaaaggacctctccgaccggccactgccggaaagacgaagcccaaatccccaactactaactattccggaggcagcaaccatcttactggcgtcccttcagaaatcaccagaagatgaagaaaaaaactttgatcaaaccagattcctggaagacagtctgcttaactggtgaaaatatactggattatgtttaattatggttctattctctttgaaaacatgaaccatgtgaataaaacctttggacccttttattccatttgtaatcttaagaacacacacagatagttttattctttcagaaacaaaatatatataggatgcttagctgagaacatcatcttctttcattgcttcaggtcctgtttagatgaccaaaaatgttttcagatcaccttgtgtcttactcttgagtttcttagaatatttataattataaggctgaagactaaagtgttctttccttttaactatagccagtacctgtcttgatcttagtgtgttttttttttcattttgttacccacttgcattttgttttcactcagcagaaattctccttctctgttttccttttatcccatccccaagaatgtggaaggaaggtgagaaacatggcaggatgggaaataggagagtatgactctctatagctcatccaggagtaatcaattaagaagataaattggatgactgtggagaagctctgtgataggaacacttcagtgtggttgctgagaggagacagtcattgaggtagaaggtttgccaaagatccagagctcagagctccctttgtgctctttgggaattaccttgcattcagtttagaaacatggatctaaaagttactgggaaataagcagatggagacacactctgttgtttacgtattggaagaagggaacaagccagttttgttagaggtaactcattttccatgaccaaacagactcaacagattcaagtactctgcttactctaattgactagactctaggttttatttgacatcatagcattacataaatcactctgataacataagtgcacagtaatatgcctgatctcttcctttttaaaagccaacttgagttcagtaccatctgaatacacacacatgcacatatacccacacacgcatacacacctactcctgtggcaaacataataatgtatttatttagaattataatatgaccatcatgttaattattttttacctaatcagagttgttattgacaaatgtcataagtggaaagtattaattcttattgtcatcagtatttagccattatttagtagctcaagaatatctttatgtgaatgtctctgtaacttggaattgcaatttcactgtgttaagtaatcagaactctgcttataagatttatctgtatcttgtttcataatttaataatgaaactaaattcaagttaatgtaatgttgatctccgtcgaaaaataacttgtgagcattaaaatatctgtatggcatta

SEQ ID NO: 280146 - DNA, 609 bp, Homo sapiens
tcagattctcaatcttgcttgaagactgacaagatgtccctgtggactcccaaactctactccagatggggaggtgcccttaacaccaagattttaaaagctccaatttcagagcaagagtcgaaaactcacagataaagttatagttatttcagggttctgaaaagacgcagaacatgaagggactcagaagtctggcagcaacaaccttggctcttttcctggtgtttgttttcctgggaaactccagctgcgctccgcagagactgttggagagaaggaactggactcctcaagctatgctctacctgaaaggggcacagggtcgccgcttcatctccgaccagagccggagaaaggacctctccgaccggccactgccggaaagacgaagcccaaatccccaactactaactattccggaggcagcaaccatcttactggcgtcccttcagaaatcaccagaagatgaagaaaaaaactttgatcaaaccagattcctggaagacagtctgcttaactggtgaaaatatactggattatgtttaattatggttctattctctttgaaaacatgaaccatgtgaataaaacctttggaccctttta

SEQ ID NO: 280147 - DNA, 452 bp, Homo sapiens
tgcgctgggagcgctggaaactcggcagccccgcgcgaccctatcctggagcaacctgccccctccccacgcccggggactgcgctgtgccgggaggagctgaggtttaagcgcgggttgtcccgggccaggctgtcgctgagccccaggtctcgtttttgcagagggtcgccgcttcatctccgaccagagccggagaaaggacctctccgaccggccactgccggaaagacgaagcccaaatccccaactactaactattccggaggcagcaaccatcttactggcgtcccttcagaaatcaccagaagatgaagaaaaaaactttgatcaaaccagattcctggaagacagtctgcttaactggtgaaaatatactggattatgtttaattatggttctattctctttgaaaacatgaaccatgtgaataaaacctttggaccctttta

SEQ ID NO: 280148 - DNA, 727 bp, Homo sapiens
tcagattctcaatcttgcttgaagactgacaagatgtccctgtggactcccaaactctactccagatggggaggtgcccttaacaccaagattttaaaagctccaatttcagagcaagagtcgaaaactcacagataaagttatagttatttcagggttctgaaaagacgcagaacatgaagggactcagaagtctggcagcaacaaccttggctcttttcctggtgtttgttttcctgggaaactccagctgcgctccgcagagactgttggagagaaggaactggactcctcaagctatgctctacctgaaaggggcacagggtcgccgcttcatctccgaccagagccggagaaaggacctctccgaccggccactgccggaaagacgaagcccaaatccccaactactaactattccggaggcagcaaccatcttactggcgtcccttcagaatagttagtagttggagaaaggacctctccgaccggccactgccggaaagacgaagcccaaatccccaactactaactattccggaggcagcaaccatcttactggcgtcccttcagaaatcaccagaagatgaagaaaaaaactttgatcaaaccagattcctggaagacagtctgcttaactggtgaaaatatactggattatgtttaattatggttctattctctttgaaaacatgaaccatgtgaataaaacctttggaccctttta

SEQ ID NO: 280149 - DNA, 1699 bp, Homo sapiens
tgcgctgggagcgctggaaactcggcagccccgcgcgaccctatcctggagcaacctgccccctccccacgcccggggactgcgctgtgccgggaggagctgaggtttaagcgcgggttgtcccgggccaggctgtcgctgagccccaggtctcgtttttgcagagggtcgccgcttcatctccgaccagagccggagaaaggacctctccgaccggccactgccggaaagacgaagcccaaatccccaactactaactattccggaggcagcaaccatcttactggcgtcccttcagaaatcaccagaagatgaagaaaaaaactttgatcaaaccagattcctggaagacagtctgcttaactggtgaaaatatactggattatgtttaattatggttctattctctttgaaaacatgaaccatgtgaataaaacctttggacccttttattccatttgtaatcttaagaacacacacagatagttttattctttcagaaacaaaatatatataggatgcttagctgagaacatcatcttctttcattgcttcaggtcctgtttagatgaccaaaaatgttttcagatcaccttgtgtcttactcttgagtttcttagaatatttataattataaggctgaagactaaagtgttctttccttttaactatagccagtacctgtcttgatcttagtgtgttttttttttcattttgttacccacttgcattttgttttcactcagcagaaattctccttctctgttttccttttatcccatccccaagaatgtggaaggaaggtgagaaacatggcaggatgggaaataggagagtatgactctctatagctcatccaggagtaatcaattaagaagataaattggatgactgtggagaagctctgtgataggaacacttcagtgtggttgctgagaggagacagtcattgaggtagaaggtttgccaaagatccagagctcagagctccctttgtgctctttgggaattaccttgcattcagtttagaaacatggatctaaaagttactgggaaataagcagatggagacacactctgttgtttacgtattggaagaagggaacaagccagttttgttagaggtaactcattttccatgaccaaacagactcaacagattcaagtactctgcttactctaattgactagactctaggttttatttgacatcatagcattacataaatcactctgataacataagtgcacagtaatatgcctgatctcttcctttttaaaagccaacttgagttcagtaccatctgaatacacacacatgcacatatacccacacacgcatacacacctactcctgtggcaaacataataatgtatttatttagaattataatatgaccatcatgttaattattttttacctaatcagagttgttattgacaaatgtcataagtggaaagtattaattcttattgtcatcagtatttagccattatttagtagctcaagaatatctttatgtgaatgtctctgtaacttggaattgcaatttcactgtgttaagtaatcagaactctgcttataagatttatctgtatcttgtttcataatttaataatgaaactaaattcaagttaatgtaatgttgatctccgtcgaaaaataacttgtgagcattaaaatatctgtatggcatta

SEQ ID NO: 280150 - DNA, 1974 bp, Homo sapiens
tcagattctcaatcttgcttgaagactgacaagatgtccctgtggactcccaaactctactccagatggggaggtgcccttaacaccaagattttaaaagctccaatttcagagcaagagtcgaaaactcacagataaagttatagttatttcagggttctgaaaagacgcagaacatgaagggactcagaagtctggcagcaacaaccttggctcttttcctggtgtttgttttcctgggaaactccagctgcgctccgcagagactgttggagagaaggaactggactcctcaagctatgctctacctgaaaggggcacagggtcgccgcttcatctccgaccagagccggagaaaggacctctccgaccggccactgccggaaagacgaagcccaaatccccaactactaactattccggaggcagcaaccatcttactggcgtcccttcagaatagttagtagttggagaaaggacctctccgaccggccactgccggaaagacgaagcccaaatccccaactactaactattccggaggcagcaaccatcttactggcgtcccttcagaaatcaccagaagatgaagaaaaaaactttgatcaaaccagattcctggaagacagtctgcttaactggtgaaaatatactggattatgtttaattatggttctattctctttgaaaacatgaaccatgtgaataaaacctttggacccttttattccatttgtaatcttaagaacacacacagatagttttattctttcagaaacaaaatatatataggatgcttagctgagaacatcatcttctttcattgcttcaggtcctgtttagatgaccaaaaatgttttcagatcaccttgtgtcttactcttgagtttcttagaatatttataattataaggctgaagactaaagtgttctttccttttaactatagccagtacctgtcttgatcttagtgtgttttttttttcattttgttacccacttgcattttgttttcactcagcagaaattctccttctctgttttccttttatcccatccccaagaatgtggaaggaaggtgagaaacatggcaggatgggaaataggagagtatgactctctatagctcatccaggagtaatcaattaagaagataaattggatgactgtggagaagctctgtgataggaacacttcagtgtggttgctgagaggagacagtcattgaggtagaaggtttgccaaagatccagagctcagagctccctttgtgctctttgggaattaccttgcattcagtttagaaacatggatctaaaagttactgggaaataagcagatggagacacactctgttgtttacgtattggaagaagggaacaagccagttttgttagaggtaactcattttccatgaccaaacagactcaacagattcaagtactctgcttactctaattgactagactctaggttttatttgacatcatagcattacataaatcactctgataacataagtgcacagtaatatgcctgatctcttcctttttaaaagccaacttgagttcagtaccatctgaatacacacacatgcacatatacccacacacgcatacacacctactcctgtggcaaacataataatgtatttatttagaattataatatgaccatcatgttaattattttttacctaatcagagttgttattgacaaatgtcataagtggaaagtattaattcttattgtcatcagtatttagccattatttagtagctcaagaatatctttatgtgaatgtctctgtaacttggaattgcaatttcactgtgttaagtaatcagaactctgcttataagatttatctgtatcttgtttcataatttaataatgaaactaaattcaagttaatgtaatgttgatctccgtcgaaaaataacttgtgagcattaaaatatctgtatggcatta

SEQ ID NO: 280151 - DNA, 2295 bp, Homo sapiens
tcagattctcaatcttgcttgaagactgacaagatgtccctgtggactcccaaactctactccagatggggaggtgcccttaacaccaagattttaaaagctccaatttcagagcaagagtcgaaaactcacagataaagttatagttatttcagggttctgaaaagacgcagaacatgaagggactcagaagtctggcagcaacaaccttggctcttttcctggtgtttgttttcctgggaaactccagctgcgctccgcagagactgttggagagaaggaactggactcctcaagctatgctctacctgaaaggggcacagggtcgccgcttcatctccgaccagagccggagaaaggacctctccgaccggccactgccggaaagacgaagcccaaatccccaactactaactattccggaggcagcaaccatcttactggcgtcccttcagaaatcaccagaagatgaagaaaaaaactttgatcaaaccagattcctggaagacagtctgcttaactggtgaaaatatactggattatgtttaattatggttctattctctttgaaaacatgaaccatgtgaataaaacctttggacccttttattccatttgtaatcttaagaacacacacagatagttttattctttcagaaacaaaatatatataggatgcttagctgagaacatcatcttctttcattgcttcaggtcctgtttagatgaccaaaaatgttttcagatcaccttgtgtcttactcttgagtttcttagaatatttataattataaggctgaagactaaagtgttctttccttttaactatagccagtacctgtcttgatcttagtgtgttttttttttcattttgttacccacttgcattttgttttcactcagcagaaattctccttctctgttttccttttatcccatccccaagaatgtggaaggaaggtgagaaacatggcaggatgggaaataggagagtatgactctctatagctcatccaggagtaatcaattaagaagataaattggatgactgtggagaagctctgtgataggaacacttcagtgtggttgctgagaggagacagtcattgaggtagaaggtttgccaaagatccagagctcagagctccctttgtgctctttgggaattaccttgcattcagtttagaaacatggatctaaaagttactgggaaataagcagatggagacacactctgttgtttacgtattggaagaagggaacaagccagttttgttagaggtaactcattttccatgaccaaacagactcaacagattcaagtactctgcttactctaattgactagactctaggttttatttgacatcatagcattacataaatcactctgataacataagtgcacagtaatatgcctgatctcttcctttttaaaagccaacttgagttcagtaccatctgaatacacacacatgcacatatacccacacacgcatacacacctactcctgtggcaaacataataatgtatttatttagaattataatatgaccatcatgttaattattttttacctaatcagagttgttattgacaaatgtcataagtggaaagtattaattcttattgtcatcagtatttagccattatttagtagctcaagaatatctttatgtgaatgtctctgtaacttggaattgcaatttcactgtgttaagtaatcagaactctgcttataagatttatctgtatcttgtttcataatttaataatgaaactaaattcaagttaatgtaatgttgatctccgtcgaaaaataacttgtgagcattaaaatatctgtatggcattaaaaaaaggcacctgtcattaattatgatttgatttgaaagtagacttactaggtagtgcttacatctgatttattgaaaattttttccaaaagcattgtcttttatttatacagtcctaaccacttcaccattaggaggggtgggacattaaaaattatttacccatcagacataaaattgtacaaattgactattcaaaatagtatgtgtattcaaagaacacttttaacatctatcttatgaaataattcttcctacaactaaccagaacaatctcaaaaatgtcatactaaccattgttttaaaagctgtctcaatgatcaatagctgttaaaatatagctccaagtattctaagtactcaaattccttgaatgttcttatgtacaaatatgctgattaattaaaaggtccctcttcccaattttctataactttc

SEQ ID NO: 280152 - DNA, 503 bp, Homo sapiens
ccacactgaaccatatcgaagaggctgggcagacctcatcgatatggttcaggctgccacactgactgatctcttcctttttaaaagccaacttgagttcagtaccatctgaatacacacacatgcacatatacccacacacgcatacacacctactcctgtggcaaacataataatgtatttatttagaattataatatgaccatcatgttaattattttttacctaatcagagttgttattgacaaatgtcataagtggaaagtattaattcttattgtcatcagtatttagccattatttagtagctcaagaatatctttatgtgaatgtctctgtaacttggaattgcaatttcactgtgttaagtaatcagaactctgcttataagatttatctgtatcttgtttcataatttaataatgaaactaaattcaagttaatgtaatgttgatctccgtcgaaaaataacttgtgagcattaaaatatctgtatggcatta

SEQ ID NO: 280153 - DNA, 806 bp, Homo sapiens
gttggcagcagcagcagctggatgccgagcgccggagctgggagctcgcgcgtccagccccgcgccaatggtggcaagggcggcccaggctggcgctgcggctccccaagccttattggcttgcggctgttcagccagccctctggctgccagggtgtgcagaggtccccagggagttaggacctgaggtgcagctcagagggaaagacgaagcccaaatccccaactactaactattccggaggcagcaaccatcttactggcgtcccttcagaaatcaccagaagatgaagaaaaaaactttgatcaaaccagattcctggaagacagtctgcttaactgcttttgtcggtcttggggaaaaggatgaagaaatgactacagtggagagatggagtcacctggcagcagctgtctgaataggggactgcgtacaggatagaaggtgattcctacacatactgccaaagccagcctcctcttcctcatcgtatctctcatcctccacttcatcttccacatcactgctctgaggactggaggcctgagaccctgaaggagaaggtggtactgaggaaggcctgggatatttaaatccttctgtctgccaaagacaaaaataagacataaacatcacaacagtttcttggctttcaacgatgtaaatactatgcatgcactatcaattttttaagtagttatctatcttttgtagtctgggtgctattaaactttgattcattttgattttgataccaccaatctcaagagggattcattcaatatatagctattctttattaagt

SEQ ID NO: 280154 - DNA, 610 bp, Homo sapiens
tcagattctcaatcttgcttgaagactgacaagatgtccctgtggactcccaaactctactccagatggggaggtgcccttaacaccaagattttaaaagctccaatttcagagcaagagtcgaaaactcacagataaagttatagttatttcagggttctgaaaagacgcagaacatgaagggactcagaagtctggcagcaacaaccttggctcttttcctggtgtttgttttcctgggaaactccagctgcgctccgcagagactgttggagagaaggaactggactcctcaagctatgctctacctgaaaggggcacagggtcgccgcttcatctccgaccagagccggagaaaggacctctccgaccggccactgccggaaagacgaagcccaaatccccaactactaactattccggaggcagcaaccatcttactggcgtcccttcagaaatcaccagaagatgatgaaaacaaccatcatcaacccagtcttcttgagggcaggatgcgatgatgctggagacggtgtggctggtggccgtgtaatctaactattgtatgtgaatacatcaatcattttgatataacgtctgaaacctttta

SEQ ID NO: 280155 - DNA, 864 bp, Homo sapiens
cttctaccacagtactttcagtggctggatggtgttcctttgtacatgggcacatggtaaatgacatttctgggacctgctgttggatggagtgacttttgatgacaaaggacaatcccagagacaagtcctggattgggctggaatgaagcgcttctctctctccatttggaaaaggatttctttccctgccagtgcgtggcactaaatgctgatgataaatgagacgtgaactcaacacagcaatgtgtaagtgaaacaacagaagtctctcagccttattgtccaattgtcagcaagaacagggcctgacaatgctcagggctctcagcctgctggcagaactcaggactcatgttcctgctacaccacattctttcctgctgataaaacatggctgacaatctgtcttccctattgttcaattttttttttttaatagcatgaaacttggcacagagaattaatgctgaatagcaagaatcatccaaacattcttacccatggagtagtcaccaaccaggtactccttcatctctgacttgttcccgccatgcactgtttccagggcactgaacaagggtctccatcccgactggatctgcgtggaacacacttcaaccagctcaccaatggatgtgacaacctggtagaggcaaagcaagtggcacttaaagccctctccttaaaaggagcagaatttctgggaagggtgatgtatttctctgtcccctattttggagttaattttagtgaaaaggaaaaaccagaatagacaaactcactcaaaaatcttctgaataatcagccgtattgtattaatttgcatttcactaatgactaatgctgcaaagcaacttttca

SEQ ID NO: 280156 - DNA, 4870 bp, Homo sapiens
ttgatcagaggatcccagttcgacggagactctcctacgccatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactttggccagaacgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaa

SEQ ID NO: 280157 - DNA, 5362 bp, Homo sapiens
gcggccgcaggggccggtctcgcgcggtctagaagtggagttgctggcggctgcggcggtgacggcggcgacggaggaggcaggcggtggggcgggggcggggactaaggattctgaggtggggagtcgggagtttctggattctttatccggaatttcaagggccgccggagggctgtcgcttctgcagtgcgtaggagcggccggggcgggaggctccgcggagccgaggcgtggagaataagaaagccttgagttttgtgaaaaaccggagaagagaaactaaaaggacagtagaaaaggcttttccagtttgcataatatttccttcatggatactttttcatagcattattatgtgatgtgagaagtttttttttttgaagtaacatggattttatactacagaatcaagagaattggcttataggaaaaattgatttataaaaagtggtacaggttttcatagataaccatgacaacatcccatatgaatgggcatgttacagaggaatcagacagcgaagtaaaaaatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactttggccagaacgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaa

SEQ ID NO: 280158 - DNA, 5291 bp, Homo sapiens
  misc_feature (5291)..(5291): n is a, c, g, or t
ttgatcagaggatcccagttcgacggagactctcctacgccatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactttggccagaacgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaaaaaaaaaaaaaaaaaaaaaaaaaaaaaaaaaggggggggggggaaaaaaaacccctgggggggcccaagtttgggtacccgtttttgggaaaagggggccccaaaagggggggggatataaaagaaaggagggggggggtaaaaggggtgccgcgggaacccgcgccgccggggaccttgggaaggacccctcttctctggcggctgtgaccattttctggcccacacccagggaaattaaagaccacagggaaacatacactctacaggcgggacagcgggcgaccaacgcgtatgcgctggcgcagaagacttcggatccgagagaggcatatgaaatatcgtgggcagacataaacacagaacaacacaacaaaagaacaagccatactacgacaaatcagatcaacatgaacacaan

SEQ ID NO: 280159 - DNA, 4078 bp, Homo sapiens
attttcatttcaactccaataccacaaagtttcagttctctgtggagtcctagaatgttcttccaataatcttgagcttacggtagacataagttttagcaaaaatgtcagtgtgttcagttacagtggtgaagtagattccctgctgggaacaaaggattctgtgtgccatattcagatgtacaacattccagaatgagagtcatgcaagaaactgcctcaggacaagccagagttgtcatatttttaatatgttttcttactgttacagaagttcaaacagttgaatgatataaattgttttgtactatgggtccaatatagtattgatgtgtgacttttatatctgagacattttgtcttgagtttaagttagttgtcttcattggcaggggtgatttgaggtgagtttcactttcttgaacccatgtgcctgataattagagggttcaggataagttttgcacatagccttgctgcctgcttatctttgtaaaatggccctttccttcagtcagtattttaaagtaggctactctatatagtttcccaaactctggtaggatacttttaactctctgcagcagatagtatagggcaagggctctttactagagccaaaagtaaatggcattttaggtccttgctccaaccagaaaggttcactccatattacagatgttactattaggaagaggttatagtgtctagaatgtttgaaaacaaatgtttgtagggaaacagtgtgtgttcttgaagcttgtagttttgttggtgagataagacaaaatatgtgaaaacctaaatagtggtataaaacaggatatattgagtcccagatggttcataatatgagtcgtgaagatgccaaagcaaaggtaaccattgtggccgtgacagggttggaaaggagctcctgaggttgggagagacagaaggaaagctatgaaggtcgctccttgttctttggccatctctgactcatcctatattatttggttaggaaaggaattatctcacagtttttatcttctgtttgcagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaa

SEQ ID NO: 280160 - DNA, 3442 bp, Homo sapiens
  misc_feature (3442)..(3442): n is a, c, g, or t
ttgatcagaggatcccagttcgacggagactctcctacgccatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactttggccagaacgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaataaaaaaaaaaaaaaaaaaaaaaaaaaaaaaaaggggggggggggaaaaaaaacccctgggggggcccaagtttgggtacccgtttttgggaaaagggggccccaaaagggggggggatataaaagaaaggagggggggggtaaaaggggtgccgcgggaacccgcgccgccggggaccttgggaaggacccctcttctctggcggctgtgaccattttctggcccacacccagggaaattaaagaccacagggaaacatacactctacaggcgggacagcgggcgaccaacgcgtatgcgctggcgcagaagacttcggatccgagagaggcatatgaaatatcgtgggcagacataaacacagaacaacacaacaaaagaacaagccatactacgacaaatcagatcaacatgaacacaan

SEQ ID NO: 280161 - DNA, 296 bp, Homo sapiens
aagaaagccttgagttttgtgaaaaaccggagaagagaaactaaaaggacagtagaaaaggcttttccagtttgcataatgtaagttcttttcacttttcttggcttgaattctgccttagctgacaaagctgtttctatggaaacaaatagtttaacctcttagaatgtcagaggaatgctgatcacttaaaatgagacttcccagctgctggtcaaagggcattacttgctggagaaagaggggaaggatgaatttaaaaaattctagagttctggacactagtgtagactgaa

SEQ ID NO: 280162 - DNA, 1023 bp, Homo sapiens
gcggccgcaggggccggtctcgcgcggtctagaagtggagttgctggcggctgcggcggtgacggcggcgacggaggaggcaggcggtggggcgggggcggggactaaggattctgaggtggggagtcgggagtttctggattctttatccggaatttcaagggccgccggagggctgtcgcttctgcagtgcgtaggagcggccggggcgggaggctccgcggagccgaggcgtggagaataagaaagccttgagttttgtgaaaaaccggagaagagaaactaaaaggacagtagaaaaggcttttccagtttgcataatatttccttcatggatactttttcatagcattattatgtgatgtgagaagtttttttttttgaagtaacatggattttatactacagaatcaagagaattggcttataggaaaaattgatttataaaaagtggtacaggttttcatagataaccatgacaacatcccatatgaatgggcatgttacagaggaatcagacagcgaagtaaaaaatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattaggtaagtaaaaatagaggtataacagaaaacattttgctttaatttatctgtgccttataatgtatatgagaaggaagagggtttaagagaatgtaagtaatgacagtttgaattccagaccaagatcctttgttttcgtggaaacgccgtataactattgtttactgttaccaacatagag

SEQ ID NO: 280163 - DNA, 5130 bp, Homo sapiens
gcggccgcaggggccggtctcgcgcggtctagaagtggagttgctggcggctgcggcggtgacggcggcgacggaggaggcaggcggtggggcgggggcggggactaaggattctgaggtggggagtcgggagtttctggattctttatccggaatttcaagggccgccggagggctgtcgcttctgcagtgcgtaggagcggccggggcgggaggctccgcggagccgaggcgtggagaataagaaagccttgagttttgtgaaaaaccggagaagagaaactaaaaggacagtagaaaaggcttttccagtttgcataataggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactttggccagaacgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaa

SEQ ID NO: 280164 - DNA, 5469 bp, Homo sapiens
gcggccgcaggggccggtctcgcgcggtctagaagtggagttgctggcggctgcggcggtgacggcggcgacggaggaggcaggcggtggggcgggggcggggactaaggattctgaggtggggagtcgggagtttctggattctttatccggaatttcaagggccgccggagggctgtcgcttctgcagtgcgtaggagcggccggggcgggaggctccgcggagccgaggcgtggagattttaagtttcttaaggatacggactctgcctcagcagcctttttcttgacaatgactatccaagtttttggtaccaagtgggtactcgccttgttgaatgaaaagaataagaaagccttgagttttgtgaaaaaccggagaagagaaactaaaaggacagtagaaaaggcttttccagtttgcataatatttccttcatggatactttttcatagcattattatgtgatgtgagaagtttttttttttgaagtaacatggattttatactacagaatcaagagaattggcttataggaaaaattgatttataaaaagtggtacaggttttcatagataaccatgacaacatcccatatgaatgggcatgttacagaggaatcagacagcgaagtaaaaaatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactttggccagaacgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaa

SEQ ID NO: 280165 - DNA, 4705 bp, Homo sapiens
tgtaatttttaaaagagttttacttaaaacctatgaaatgaccatgattgacaataatatatgcagattttggtatttttctgaaaacttaaattgttactggttcaaagaaatgttctctgaaaatgcatgttgaattaatactgaaacagttaatttttggataccttttcttcttctactagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactttggccagaacgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaa

SEQ ID NO: 280166 - DNA, 4274 bp, Homo sapiens
ttgatcagaggatcccagttcgacggagactctcctacgccgcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactttggccagaacgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaa

SEQ ID NO: 280167 - DNA, 559 bp, Homo sapiens
ggcggccgcagggaggcagccattttccgtaggcggtggccgcggcgcttccgggccgcgcggctggagcctgaggcggggccaccgtcgggcacgagaaaccattctctccccgcttttcgcagctgtatcccagaggcgcggctgaagctcgctgggacactgcccgcttgcccagtgcccacgggcacgcctgtcgcagacacaggctgtggcgaatccgagtgctggcgggcagcagtgcctgcagctgcgcccgcagactctttcccgcctccgccggcatttccgtgtccggccgatgtcatgcggtcggttgagcctcagggctagcagcttctactgatgcaaaaacataggaagtgtctctttgcttctggaaccggggtgggcagcaaggagctggccacttctttgaataccggtggcatcctgggcagaatttcggtgccgtttctgctggctcacttcaggaaaagtgaggctcacggctctcctcagccccccttagaagtctaaatgacctttggagaaatacaaagtcagcagaaagtttcac

SEQ ID NO: 280168 - DNA, 561 bp, Homo sapiens
acaaccctctgttgagagaattctgagagtgtcttaccacagctctccagagcatattattttgcacctcttctgtgaaggccggcaaaatagcttcttgaaaggttctctgttaatggaaactgaagtttgtaagagtttaaggccaaacgtaagaggtcatactccctgtcacaaactccagctgaactaacttggaggaggatcttccctgacagctctggaaggaaattgacagaactttcataaagccaaagactggcagaaataaagtaaataatgatgaaactgagcaatagagcacccagaaggagtgtcccctgccaaaaagaatgtggcatttcaccctccaagaaacaaatggacaccttatcccacagaagaatggggctcacaggtcaccgtcactcacttctttatcctttcgccaaaggaagccacttcatctaggatgttctggacactgacacatacctcctggatggcatagattttatttataaatccctttttttcactgtcctaaaatgcaataaaaaagaaattctgtatgagtaaaag

SEQ ID NO: 280169 - DNA, 654 bp, Homo sapiens
tgataattatggatctcagctatttaaatacaaacttgaaaaaaatatttttgcagggtaccataaatatgattaattttttaaaaaatttagtgtcacttgatgaaaatataactagaccaatagtaaaatacaggtgtatcttaattacctgaagtcctcatttagcttggtttatttttttcctatcacaatttcatattccatttaagaacaaagtctttcacagtgaaaaatgtgctaaaatttaggacggtgttatttcttcaaagctacaagtatgacttctttccaaccaatatgttctaaatttcaggaaggaaattgacagaactttcataaagccaaagactggcagaaataaagtaaataatgatgaaactgagcaatagagcacccagaaggagtgtcccctgccaaaaagaatgtggcatttcaccctccaagaaacaaatggacaccttatcccacagaagaatggggctcacaggtcaccgtcactcacttctttatcctttcgccaaaggaagccacttcatctaggatgttctggacactgacacatacctcctggatggcatagattttatttataaatccctttttttcactgtcctaaaatgcaataaaaaagaaattctgtatgagtaaaag

SEQ ID NO: 280170 - DNA, 1091 bp, Homo sapiens
aactgtgctagaagctcatctaatggcattacaagttttaaattcaccatagcagcttcttcctgaaatcagaaagctttttttctgtctgcagctggagtgcgatggcatgatctcggctcactgcaacctctgcctcccaggttcaagcgtttctcctgcctcaccctcccaagtagctgggattgcaggcatgcaccactgtgcccaggaagctgagagtgctgagggcacatctgaaaccactggaggttggcgacatggaggtcagaactgaagaatttggaagtgctcaaatttttaaataaccagatcgaggagctgccaacacagatcagcaggcttcaaaaactcaaacacctgaaccttggccaccctgtgtgcactctatctaagtgacaacggttttgaaatcctgccaccagatattgggaagctcacaaagttgcagatagtaactcagcaatagggataaagacctgatctcactgcttaaggaaattggggagcttacccagcttaaagagctccacattcagaggaaccgcctcactgttctacgcccagaactaggcaatgatgggacctcttctcctgcatttgttacccagataattttgcctttggagaagagaagaaaatcacattggtctgctcggaatgcaacaaaacaaagtgttattgacaccaaaaccttatttgcaccaatccaaacagcctatgggacatatgtctgcaatgctgcacacacctggggctagccagcttagtgccctacgatatgtgccaataatcgatagcattttttactacagtaattatgagaagcatagtattttctagcatgcttgtgaagagtggaaacaaatattaatccccttcagagagtaaaggacattatgaattgagaatttcctcccaatttattctccagaatgaacagaattaacagtgagtggatgtacgtccaaaatttcttctgttatatctcttaatccttttcctgcggacatcgagaaactaaagaaaaataactttctttactgaggcaggcaagaaggaaatccagtattctttgtttgatcaattaa

SEQ ID NO: 280171 - DNA, 1034 bp, Homo sapiens
caagaagctaagcactgctacttgaataaccaaacctatgcccaaatcccatctttgtggggctatctcctggtactcttcctagcatttttctctttgtcagagtccaatcaggagacataaatcacttaaatacaaactggtaacatttaatgaagctgagagtgctgagggcacatctgaaaccactggaggttggcgacatggaggtcagaactgaagaatttggaagtgctcaaatttttaaataaccagatcgaggagctgccaacacagatcagcaggcttcaaaaactcaaacacctgaaccttggccaccctgtgtgcactctatctaagtgacaacggttttgaaatcctgccaccagatattgggaagctcacaaagttgcagatagtaactcagcaatagggataaagacctgatctcactgcttaaggaaattggggagcttacccagcttaaagagctccacattcagaggaaccgcctcactgttctacgcccagaactaggcaatgatgggacctcttctcctgcatttgttacccagataattttgcctttggagaagagaagaaaatcacattggtctgctcggaatgcaacaaaacaaagtgttattgacaccaaaaccttatttgcaccaatccaaacagcctatgggacatatgtctgcaatgctgcacacacctggggctagccagcttagtgccctacgatatgtgccaataatcgatagcattttttactacagtaattatgagaagcatagtattttctagcatgcttgtgaagagtggaaacaaatattaatccccttcagagagtaaaggacattatgaattgagaatttcctcccaatttattctccagaatgaacagaattaacagtgagtggatgtacgtccaaaatttcttctgttatatctcttaatccttttcctgcggacatcgagaaactaaagaaaaataactttctttactgaggcaggcaagaaggaaatccagtattctttgtttgatcaattaa

SEQ ID NO: 280172 - DNA, 1078 bp, Homo sapiens
gacgggtcccaaaactggcttgccacagtccctttcagtattgctgtgatgagacgcctggaggaaagctgtcagagcagatgtgtgtagaggaagaaagttgtgtagtcgaaggacagtgttgtttactcttatcttgagtgtgagtagagaactgtattaacaatagggctttgtgccattgacagagtgtgaaagagggagcctatattacattggggtttgggacctgacctgcctatatctagccagcgagagtgaatggggtcagtgttagctgccttcatctatgcagtcacaaaggtggcttaagattaagaagtgaggacatggaggcggactgtccctctgagcagctctgaagtagggccaagcacactgccttccagtaagttcttgcccacattccttcactcccttgacgtagatgtctccaaatactcttaacatgaaatgcatgtaatgaggagcaggcctgtcatagatcttgatttggggcaataaagatgtgtttttgtcacagaactttttgaggatgacactgtaaatccctaacttttattttctcagtgcatggtgacccccatagctgtttttcccaatagttctgtcagcaggcattttccaagaaggggccccagtattccttcctaaatggtgaggtggtcaagacgtcagaccagttggtggtgtgatattttttcaaggttctgaatgatggattatttgcttgtgcttagagattgcctactttttcttgctttcagttatgttaaagaaggcgagggaaatgttacttattggccgaaatcatctaatgtcttttttgtgaacaagaaattaatttgttaggacttttgtactataaattagaggtaatcttaagatttaaaaaaagaagaaaacacccttaaatgataactttattggctccctgtgtctttatttcctgtatttcctggtggaggtacttatatttggcttttactcatttaataattccagaccccaggagaaagcctggcttttgatgtctggtctggtctctgatgataacaaggaattcccctcccaaggg

SEQ ID NO: 280173 - DNA, 336 bp, Homo sapiens
gaagaattgaggcacagcacagcaactggcagagaaatggaaaaagaacactccaaacctggccactacctgaggatgtgtaaagaggttttctgcaggcaattagaccccactacagtggaagcttgtagaacatcacacatcgacagtctgaaatgcaccacaagaactgctcgaagagtgtgtcactttcacacttacctgaccgtgggatggaagtgcagcgtgaagctgtggtgccaggagctgaagtatgctgttcatccaatgcctatgacaatatgggctgctatcatgtgtcaattactctgaaggaaacaattcatcttccataat

SEQ ID NO: 280174 - DNA, 533 bp, Homo sapiens
aatcatattagtgaagattaggaagaagctttaaaatcccaaggctagtgtgcattgctagaattgttaagagagagagctcatatgaaattggttatcgtgggatatttaaaataaaacaaagaacagtttactttcaggcaaaaagatgccagtaatcaatattgaggacctgacagaaaaggacaaattgaagatggaagttgaccagctcaagaaagaagtgacactggaaagaatgctagtttccaaatgttgtgaagaagtaagagattacgttgaagaacgatctggcgaggatccactggtaaagggcatcccagaggacaaaaatcccttcaaggagctcaaaggaggctgtgtgatttcataatacaaacaaaaagaaaaaaaattaaacaaattcttggaaatatctcaaatgttaataacaatatgaatttttctcatgcatactattactactaagcatgtacgtgaatttttaaatttatagatgtaaacttttaataaaaattggggtgtggtaaccc

SEQ ID NO: 280175 - DNA, 678 bp, Homo sapiens
tattcattctcctccacctttactagtcacatttttgggatgaggaaaaagatttaatcaatatgaactctggtgacacccttgacttctgttgccagctgtgttgtgaaccctgggtcttgtctcctttgatgttggaggcagtgtctgctgggaatctttagctggagtgtggccagctgtttttcctttgtctggagatatatccagaaggagtgggaagggtgcaactttcttctttcctacaaagtaaatatgcattggtgtaaagtagagagaatcaaactgaaattatacaacctgaaaatttattgtaataaataaattcctggcatctggagtattctgttttaaaccaaatgagtcatccctttttccttccccttaaggtttccaaatgttgtgaagaagtaagagattacgttgaagaacgatctggcgaggatccactggtaaagggcatcccagaggacaaaaatcccttcaaggagctcaaaggaggctgtgtgatttcataatacaaacaaaaagaaaaaaaattaaacaaattcttggaaatatctcaaatgttaataacaatatgaatttttctcatgcatactattactactaagcatgtacgtgaatttttaaatttatagatgtaaacttttaataaaaattggggtgtggtaaccc

SEQ ID NO: 280176 - DNA, 723 bp, Homo sapiens
aggtgaggcaatgcctcgccctgcttcggctcgagcacggtgcgcacacacactggcctgcgcccactgtctggcactccctagtgagatgaacccggcacctcagatggaaatgcagaaatcacccgtcttctgcgacgctcacgctgggagctgtagaccggagctgttcctattcggccatcttggctcctcctcttatgatcctcttctgaaatcaggaatacgaccccaagaaatgacaggcaaaaagatgccagtaatcaatattgaggacctgacagaaaaggacaaattgaagatggaagttgaccagctcaagaaagaagtgacactggaaagaatgctaatcccagccaggcaccttcaaaaccaatcccttatggactactgaattaaggacagcaagttacacctctgttcctgtcatctgggtgaagccaaaagtagtgacttttagagagagagtgtgggaccactgaggaagagggaaaaaagtgaatctaaattaatgcatatttcaaaagttatgtgaatctgcaagtatcatcctttgaaggaagaaactaacctgacaaatgcttcctggctccagttgaaaataatttgttttactatgtaattaatgagtctgcctagttataaaataatcttaagtcttatatcaaatgttccttggaatttacataaaagcggactaaagatttcatttgaaaaaaaaaa

SEQ ID NO: 280177 - DNA, 546 bp, Homo sapiens
tcctcctttctggagtctgaaatgttaagtatggaggcaaaagctgaagctggagcaacagtctcagaatatgacaacaaccatgagaatggaggccattcatagcagaactacgagacaagaggagcctaggtccctgagctgcagaactgcatactaacctgatgagaagactaatgctcagtgaggtgaactccttcagggccacaggctgtaaagatctaaacaccatctgatccagtttcaatatgactgcctggatgaagaaggatttgagactaagtttattcctccaaagcaaaccaactgagaatgcagtttctgaggaccttggctcatttcaaaatctggaaatatatttgaacacctctcccagaagtgggtaagaagttagaataatggaaaggcttggctccaagttcagttgaatgtcaaaaagcccaagtttggctgaatggactttgtgtcgtgaaatctcagctccctctctcttcttccaggccaaatacctactggatgaaactgataaaattaaacaaagagaga

SEQ ID NO: 280178 - DNA, 804 bp, Homo sapiens
tcctcctttctggagtctgaaatgttaagtatggaggcaaaagctgaagctggagcaacagtctcagaatatgacaacaaccatgagaatggaggccattcatagcagaactacgagacaagaggagcctaggtccctgagctgcagaactgcatactaacctgatgagaagactaatgctcagtgaggtgaactccttcagggccacaggctgtaaagatctaaacaccatctgatccagtttcaatatgactgcctggatgaagaaggatttgagactaagtttattcctccaaagcaaaccaactgagaatgcagagacagggtcttgctatgttgcccaggccagtctcaaactcctgggttcaagcaatccactcgccttggcctcttaaagcactgggattacaagcgtgaaccaccatgcctggctgaagattcaagtttttaaaacatctgatttccacttgaaaccttgaattgtatcattggcaacaaataatgtcagttattttccttgagatgacaacttcacttagttattttcaagaaaactgctgccatgtagccaactgtgaatgaccacagtttgcctgtcagtcattctgtcaagtaaaatggtgctcctcaaacaaagcagcacgtttagctcacaactcaacaaccacacagcagtcttcctcccacccaccatggcacttatattaatataagcagcagaggtgctttatgtatgagtattgtgtgaaaatactcaaaagacctgtaaccaagggtcaagattactacaattaatttctactg

SEQ ID NO: 280179 - DNA, 663 bp, Homo sapiens
tcctcctttctggagtctgaaatgttaagtatggaggcaaaagctgaagctggagcaacagtctcagaatatgacaacaaccatgagaatggaggccattcatagcagaactacgagacaagaggagcctaggtccctgagctgcagaactgcatactaacctgatgagaagactaatgctcagtgaggtgaactccttcagggccacaggctgtaaagatctaaacaccatctgatccagtttcaatatgactgcctggatgaagaaggatttgagactaagtttattcctccaaagcaaaccaactgagaatgcagttttcaatgcaacccatcatcaaagggaaggagttgatgaaaagaaatgaaattgaaacgtgcacctggggagaagtgattgaaggttcttcatttaagggattggctccttttctcttattatactgtgaaatctgaaaacatctcttgaaattctggtcactgtcttctggacatcccaaggcgcaccatctccacagttcctccctcctagattatcccatccagtgtggcatccagtgtggcaaatggaaagactcttccagtgggcaactgaaaaggacaccaaagaaagcagatacagcccatgatcaaagaagcacataacttcagtttggaacatga

SEQ ID NO: 280180 - DNA, 1875 bp, Homo sapiens
gcatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaggcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtggtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctagccagctcccagcactgaggagaccagcatctgtttgggaagataaaagaaaaagccctcagcctcagcagcatttcctttctttctgctttttatttattttgcctttttatcatgatcgagagaatctgtaaatagtgtacaaaggcatatgtctttgaatatatacttctattgtacagactcaacttgataaaggttttgctactgctgtgtcaaaaccttgttagctgtggataataatataacacactgaaagaacaaatataagaatgataacactggaagatatattcttatctaattacaagtggattaaatactcacctgtgctctgattaaatctacatcaattgtaaatgtcgatttgattttaaagtttttttttaatgcgactattttttatctgaaaagtaatccattacacttttctatgttttatacatttcaaaagggagggaaattccaaagcctgaataatggaatggatacatttcaatttaacatatattctggctttagatcccgacattcactcctgtgcaaattacttaggtatgacttaggctaattttaagctaataagtgaaggtacattcactccctcaagagaatcaatactcagaaggttacaaagttttctttatagaatttcaatcaatcattccatctaaaaccttaaaatctctacaggactacataacataaatactgccagtttataaacgattgcctatctgaatttttatacctaccactactttaatttatacagttagttagcaaattagcaacccagtaagtacagttatcaaaaatactaggaaactatatccatatcgcttttggtgtcagattgtatctgtgcatctaaaaatattttaataaatactcaagtgctctcagag

SEQ ID NO: 280181 - DNA, 246 bp, Homo sapiens
aaatcagctggagctatctaaattttcaaaactattcttgttgttgtttcctactgatgaaatctttttttcttacatatatttattatgcagcaacattaaagatatccattcagttcttgaagtgacagtttatgatgaagatcgggatcgaagtgctgactttctgggcaaagttgctataccattgctgtctgtaagttttattcacctgacacactgttctgtgttgcttttgctcacgga

SEQ ID NO: 280182 - DNA, 2929 bp, Homo sapiens
gcatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaggcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtggtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctagccagctcccagcactgaggagaccagcatctgtttgggaagataaaagaaaaagccctcagcctcagcagcatttcctttctttctgctttttatttattttgcctttttatcatgatcgagagaatctgtaaatagtgtacaaaggcatatgtctttgaatatatacttctattgtacagactcaacttgataaaggttttgctactgctgtgtcaaaaccttgttagctgtggataataatataacacactgaaagaacaaatataagaatgataacactggaagatatattcttatctaattacaagtggattaaatactcacctgtgctctgattaaatctacatcaattgtaaatgtcgatttgattttaaagtttttttttaatgcgactattttttatctgaaaagtaatccattacacttttctatgttttatacatttcaaaagggagggaaattccaaagcctgaataatggaatggatacatttcaatttaacatatattctggctttagatcccgacattcactcctgtgcaaattacttaggtatgacttaggctaattttaagctaataagtgaaggtacattcactccctcaagagaatcaatactcagaaggttacaaagttttctttatagaatttcaatcaatcattccatctaaaaccttaaaatctctacaggactacataacataaatactgccagtttataaacgattgcctatctgaatttttatacctaccactactttaatttatacagttagttagcaaattagcaacccagtaagtacagttatcaaaaatactaggaaactatatccatatcgcttttggtgtcagattgtatctgtgcatctaaaaatattttaataaatactcaagtgctctcagagaaaaaaaaaacctgctttctcattagattactgaaatgctttaattcatactatgattttgttattagtgtgaattttaatgtagagaattcagtgtgctaagtgatatgccagtgtttcactacattcatttattaaaaaaaatcattcttgattatgcatgaaaacctgttttgtaaaataaaataaactgcttgggggtggtggttgcctttatcaatgtttcactattatcatagaatctatacttaaaaattgcattcccaagactcttaaagtagtttttatatctcactccctggtatactaagggagcataactctggagaaaaaataatttggttggttgagaatgtcttacttccctgacttggtaggggactacactcagttgaaattgcagcagacaatgctttgcactactttattaataataaacttggatggggtaaaagtgggggttatactggaaaaactatagaaaagctaaaagaaatgtatatttcactctaaaggaagattctttaacaataaatgtaatctcattgaagctgatttttaaagtatttttattttagagataagttgttaaatactatttcttataatagaactattttgatctgtttatatactatgcttgaatgtcaattaaattccctttctacagaaaggctttgacctcaacatgctttatttaatgtatcatgtttaaaatgacatgcttctgtctgcataccatcactgtttgttgctaaaaacataatgttccatgaacatgatgttactacagaaagtttattgatgagataactgtttgaaataactttcaattataccttatgtgagacttttatgttctgtgctgacaatgtgtactcaaatgtctataagcctgatattctacaacctcagatgtatctagtggatagtaaccattaacagatgactaatttgtttcactgtatcaaatttcagatgtttagttcaatggtaatgctgactacacattcactgtattaaatacaaaagaaaataatctttcccacgtata

SEQ ID NO: 280183 - DNA, 1718 bp, Homo sapiens
agactcggtggttgctaaggcgggaggtcacagagcgcggcgcagggattgggccgtgttgggggaggtgtgtggtgattgggcggcgcccaggaggcgcccgggtgaggcacgggtgcgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctgaggccattgctccatctcacctctgctccagaaataaatgcctgacacctccccacaacctgcaatctgtcgggcactcttctcgttcaactccctgtagccctttgggactttgcggtcccctaagtagaaaattcctatgggcctgtctcctgggggcctctgtctgctggtggtctgcttaccacagaatcctaaggggcaggagtgcctgggcatgtgtctgtgggagccttgcagtcagttgtgtttggacaagtgcaacagtcaggctgctgattcctgtggcatgcaggctgtagaggttgacaaatggaggggggtgttgagggtgagccctagttgattttttaaaatttaaactctggtaagaacatttaatatgagacctactctctttttttctttacttatttatttatctatttatttcaagacagggtctcactctgtcacctaggctggggtgcaatggtgcaatcatggctcactgcagcctcaacctcccaggctcaagtgatcctcccacctcagcctcccaaagtgctaggattacaggcatgagtcaccgcgcctggccaagatcacctaacaaaattgtaagtgtgtacgatacttaaaatttaagagattatgtgcacggcagacctctagaactgaatagtcttgcatcttgcataattcagaacttcatcatcttgcataactgaaactt

SEQ ID NO: 280184 - DNA, 675 bp, Homo sapiens
agactcggtggttgctaaggcgggaggtcacagagcgcggcgcagggattgggccgtgttgggggaggtgtgtggtgattgggcggcgcccaggaggcgcccgggtgaggcacgggtgcgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggaagctgctcgagctgctctttgattatgagattgagaaggaagcaggatcatgctgggcccaggccatccccacctgctccccacagtctgcaacgaaggcacagctctagccccagctgtggtgtgccaagtgggccctcagctctagggctcctttgaagcaaaccaatttagaggtcaaagacctgggcctcttcccaatagttttccgctggagcccaaggagggaatgagtgagagtgaaagcaaaaggagagagcagtggtcagaagggaagaagctgctgagaccacatggagaccccaagagcccacagattca

SEQ ID NO: 280185 - DNA, 1671 bp, Homo sapiens
agactcggtggttgctaaggcgggaggtcacagagcgcggcgcagggattgggccgtgttgggggaggtgtgtggtgattgggcggcgcccaggaggcgcccgggtgaggcacgggtgcgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctgaggccattgctccatctcacctctgctccagaaataaatgcctgacacctccccacaacctgcaatctgtcgggcactcttctcgttcaactccctgtagccctttgggactttgcggtcccctaagtagaaaattcctatgggcctgtctcctgggggcctctgtctgctggtggtctgcttaccacagaatcctaaggggcaggagtgcctgggcatgtgtctgtgggagccttgcagtcagttgtgtttggacaagtgcaacagtcaggctgctgattcctgtggcatgcaggctgtagaggttgacaaatggaggggggtgttgagggtgagccctagttgattttttaaaatttaaactctggtaagaacatttaatatgagacctactctctttttttctttacttatttatttatctatttatttcaagacagggtctcactctgtcacctaggctggggtgcaatggtgcaatcatggctcactgcagcctcaacctcccaggctcaagtgatcctcccacctcagcctcccaaagtgctaggattacaggcatgagtcaccgcgcctggccaagatcacctaacaaaattgtaagtgtgtacgatacttaaaatttaagagattatgtgcacggcagacctctagaactgaatagtcttgcatcttgcataattcagaacttcatcatcttgcataactgaaactt

SEQ ID NO: 280186 - DNA, 1476 bp, Homo sapiens
agactcggtggttgctaaggcgggaggtcacagagcgcggcgcagggattgggccgtgttgggggaggtgtgtggtgattgggcggcgcccaggaggcgcccgggtgaggcacgggtgcgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctgaggccattgctccatctcacctctgctccagaaataaatgcctgacacctccccacaacctgcaatctgtcgggcactcttctcgttcaactccctgtagccctttgggactttgcggtcccctaagtagaaaattcctatgggcctgtctcctgggggcctctgtctgctggtggtctgcttaccacagaatcctaaggggcaggagtgcctgggcatgtgtctgtgggagccttgcagtcagttgtgtttggacaagtgcaacagtcaggctgctgattcctgtggcatgcaggctgtagaggttgacaaatggaggggggtgttgagggtgagccctagttgattttttaaaatttaaactctggtaagaacatttaatatgagacctactctctttttttctttacttatttatttatctatttatttcaagacagggtctcactctgtcacctaggctggggtgcaatggtgcaatcatggctcactgcagcctcaacctcccaggctcaagtgatcctcccacctcagcctcccaaagtgctaggattacaggcatgagtcaccgcgcctggccaagatcacctaacaaaattgtaagtgtgtacgatacttaaaatttaagagattatgtgcacggcagacctctagaactgaatagtcttgcatcttgcataattcagaacttcatcatcttgcataactgaaactt

SEQ ID NO: 280187 - DNA, 1450 bp, Homo sapiens
agactcggtggttgctaaggcgggaggtcacagagcgcggcgcagggattgggccgtgttgggggaggtgtgtggtgattgggcggcgcccaggaggcgcccgggtgaggcacgggtgcgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtcttctgcatggcctcctgcttgctgctttcaccattgctggtggatggcatctctgctgggacagaggggcaactcacactccggccagactgggcagcacaggtgctaacgcggcttggctgtcaccttcaatgcatcacccgaagctgagagccccccttcgtcactcctagcttgcagcctcacaattccatttccccacccaaatacatccattttaatatgcacatcacaggcaggcagcacggtcacaaaggagccccaccagcagcagtccccacgtggtggaacggatggatgaccagccaccagcctcggcctcttggcttccagcagatggatacccagcagaggcctggcaccagagtgccaatgtctacgtgtcagctgcttgtacctcggaagccaccttccaggagagtggtggcccgtatccgcttctgtccacaccactcatactcctcaaagcggttgttgttctcatgctcgatgtccacagcatcatcctcagccatgcaggagccttccctctgtgaagagcagagcaggatcatgctgggcccaggccatccccacctgctccccacagtctgcaacgaaggcacagctctagccccagctgtggtgtgccaagtgggccctcagctctagggctcctttgaagcaaaccaatttagaggtcaaagacctgggcctcttcccaatagttttccgctggagcccaaggagggaatgagtgagagtgaaagcaaaaggagagagcagtggtcagaagggaagaagctgctgagaccacatggagaccccaagagcccacagattca

SEQ ID NO: 280188 - DNA, 953 bp, Homo sapiens
agactcggtggttgctaaggcgggaggtcacagagcgcggcgcagggattgggccgtgttgggggaggtgtgtggtgattgggcggcgcccaggaggcgcccgggtgaggcacgggtgcgcaagcgggagttccggctggagacccgtgctctgggccggcgccttcaccatggcctcggcagagctggactacaccatcgagatcccggatcagccctgctggagccagagtgctaacgcggcttggctgtcaccttcaatgcatcacccgaagctgagagccccccttcgtcactcctagcttgcagcctcacaattccatttccccacccaaatacatccattttaatatgcacatcacaggcaggcagcacggtcacaaaggagccccaccagcagcagtccccacgtggtggaacggatggatgaccagccaccagcctcggcctcttggcttccagcagatggatacccagcagaggcctggcaccagagtgccaatgtctacgtgtcagctgcttgtacctcggaagccaccttccaggagagtggtggcccgtatccgcttctgtccacaccactcatactcctcaaagcggttgttgttctcatgctcgatgtccacagcatcatcctcagccatgcaggagccttccctctgtgaagagcagagcaggatcatgctgggcccaggccatccccacctgctccccacagtctgcaacgaaggcacagctctagccccagctgtggtgtgccaagtgggccctcagctctagggctcctttgaagcaaaccaatttagaggtcaaagacctgggcctcttcccaatagttttccgctggagcccaaggagggaatgagtgagagtgaaagcaaaaggagagagcagtggtcagaagggaagaagctgctgagaccacatggagaccccaagagcccacagattca

SEQ ID NO: 280189 - DNA, 1058 bp, Homo sapiens
agactcggtggttgctaaggcgggaggtcacagagcgcggcgcagggattgggccgtgttgggggaggtgtgtggtgattgggcggcgcccaggaggcgcccgggtgaggcacgggtgcgcaagcgggagttccggctggagacccgtgctctgggccggcgccttcaccatggcctcggcagagctggactacaccatcgagatcccggatcagccctgctggagccagagtcttctgcatggcctcctgcttgctgctttcaccattgctggtggatggcatctctgctgggacagaggggcaactcacactccggccagactgggcagcacaggtgctaacgcggcttggctgtcaccttcaatgcatcacccgaagctgagagccccccttcgtcactcctagcttgcagcctcacaattccatttccccacccaaatacatccattttaatatgcacatcacaggcaggcagcacggtcacaaaggagccccaccagcagcagtccccacgtggtggaacggatggatgaccagccaccagcctcggcctcttggcttccagcagatggatacccagcagaggcctggcaccagagtgccaatgtctacgtgtcagctgcttgtacctcggaagccaccttccaggagagtggtggcccgtatccgcttctgtccacaccactcatactcctcaaagcggttgttgttctcatgctcgatgtccacagcatcatcctcagccatgcaggagccttccctctgtgaagagcagagcaggatcatgctgggcccaggccatccccacctgctccccacagtctgcaacgaaggcacagctctagccccagctgtggtgtgccaagtgggccctcagctctagggctcctttgaagcaaaccaatttagaggtcaaagacctgggcctcttcccaatagttttccgctggagcccaaggagggaatgagtgagagtgaaagcaaaaggagagagcagtggtcagaagggaagaagctgctgagaccacatggagaccccaagagcccacagattca

SEQ ID NO: 280190 - DNA, 1628 bp, Homo sapiens
agactcggtggttgctaaggcgggaggtcacagagcgcggcgcagggattgggccgtgttgggggaggtgtgtggtgattgggcggcgcccaggaggcgcccgggtgaggcacgggtgcgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctgaggccattgctccatctcacctctgctccagaaataaatgcctgacacctccccacaacctgcaatctgtcgggcactcttctcgttcaactccctgtagccctttgggactttgcggtcccctaagtagaaaattcctatgggcctgtctcctgggggcctctgtctgctggtggtctgcttaccacagaatcctaaggggcaggagtgcctgggcatgtgtctgtgggagccttgcagtcagttgtgtttggacaagtgcaacagtcaggctgctgattcctgtggcatgcaggctgtagaggttgacaaatggaggggggtgttgagggtgagccctagttgattttttaaaatttaaactctggtaagaacatttaatatgagacctactctctttttttctttacttatttatttatctatttatttcaagacagggtctcactctgtcacctaggctggggtgcaatggtgcaatcatggctcactgcagcctcaacctcccaggctcaagtgatcctcccacctcagcctcccaaagtgctaggattacaggcatgagtcaccgcgcctggccaagatcacctaacaaaattgtaagtgtgtacgatacttaaaatttaagagattatgtgcacggcagacctctagaactgaatagtcttgcatcttgcataattcagaacttcatcatcttgcataactgaaactt

SEQ ID NO: 280191 - DNA, 1058 bp, Homo sapiens
agactcggtggttgctaaggcgggaggtcacagagcgcggcgcagggattgggccgtgttgggggaggtgtgtggtgattgggcggcgcccaggaggcgcccgggtgaggcacgggtgcgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctgaggccattgctccatctcacctctgctccagaaataaatgcctgacacctcccca

SEQ ID NO: 280192 - DNA, 1180 bp, Homo sapiens
agactcggtggttgctaaggcgggaggtcacagagcgcggcgcagggattgggccgtgttgggggaggtgtgtggtgattgggcggcgcccaggaggcgcccgggtgaggcacgggtgcgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaagggtcttctgcatggcctcctgcttgctgctttcaccattgctggtggatggcatctctgctgggacagaggggcaactcacactccggccagactgggcagcacaggtgctaacgcggcttggctgtcaccttcaatgcatcacccgaagctgagagccccccttcgtcactcctagcttgcagcctcacaattccatttccccacccaaatacatccattttaatatgcacatcacaggcaggcagcacggtcacaaaggagccccaccagcagcagtccccacgtggtggaacggatggatgaccagccaccagcctcggcctcttggcttccagcagatggatacccagcagaggcctggcaccagagtgccaatgtctacgtgtcagctgcttgtacctcggaagccaccttccaggagagtggtggcccgtatccgcttctgtccacaccactcatactcctcaaagcggttgttgttctcatgctcgatgtccacagcatcatcctcagccatgcaggagccttccctctgtgaagagcagagcaggatcatgctgggcccaggccatccccacctgctccccacagtctgcaacgaaggcacagctctagccccagctgtggtgtgccaagtgggccctcagctctagggctcctttgaagcaaaccaatttagaggtcaaagacctgggcctcttcccaatagttttccgctggagcccaaggagggaatgagtgagagtgaaagcaaaaggagagagcagtggtcagaagggaagaagctgctgagaccacatggagaccccaagagcccacagattca

SEQ ID NO: 280193 - DNA, 1307 bp, Homo sapiens
caggctgtaccggccgaagtcttagatcctggacagggctgcggtaggccagcggtgggctggcggttgcgctcctcagatcggcggcctttcgggcggtggcttgcgtttgagcctcagaaagcgaggagcggcctccacggaagccaagctggccgagtgcttttaggaagaagatccttttattgcttttgtacaagaccagacaggatctcatttgttaaacgtggtaccaattgggtgtcttaacacaggagcagaacttcctagagcagaatgatgatggtagatctgaaagtggctgcgtacttggaccctcagatcagggctttgtgggagaccaaggggcctgcaagagagagctccggtcagagtaaaaaatctcctcaaatggactgtctcgatcctaagagctcttgctggcacttccggaatttcacctatgatgaagcaggtggaccccgtgaggctgtcagcaaacttcaagaattatgtcatctatggctgaagccagagatccactcaaaagagcagatactggaactgctggtgctggagcagttcctgactattctgcccagggagacacagacccagatgcagaagcaccatccacagagcattgaggaggctgtggctctggtagaacacttgcagagggaatctggtcaaacatggaatggggtgagaagaaagattcctgacatgtacagtgaaataggatgcaggtggatatagtagagatggtggcagttagttgagaaattagatggattaggtaggtcattgttggttttcttcttaaggacagttaaggtgggacttgaaactacaggcccacagaaaagttcacaggtttcagagattgtggtagatacttccctggccttagagaaagagagttgcttttgccctctttggagccagggtgaattgagggtgttgggcctagtctggcttggccaaggagacaggacttaagtacttagaaacagaataaaaggtaataaagagtcagggaggctggatgcagtggctcacacctgtaatctcagcactttaggaggctgaggcgggtagatcacctgaggtcaggagttcaagaccagcctggacagcatggtggaaccctctctctacaaaaataaacaaattagctgggcatgatgaccggtgcctgtaatcccggctatcctcgaggctgaggagggagaatcatttgaacctgggaggttgcagtgagccgagatcgcaccattgcactccagcctgggcaacacagcaagactccatctcacaaaaaaaaa

SEQ ID NO: 280194 - DNA, 978 bp, Homo sapiens
tgtcccgctcggggctggaatccgcccgggaggcgcgcgcaggccgcgcagccagaagccgcagccgggaccggctgtgccgcagcggcgcgcgccccccgccccggaccgcgcggccacgcggctgagtcacccagcgcttcacgttaagagtcccctccgcgcgtggcacgccgggaaggccgtgtctggggaccccgtccggggccgcaccgtaaatgggtgtcgcctttcctccagtccactctgcacccaacctcagcgggcgcacttttctgagttgcgcataccctctcaattattaaaggttgcagacggaaaagttagtagttttcggaattgtagaatacgctcgtgcagcgccaggacggctaatgcttacccgaaaatgtggaaccctgatctccccatgcgtggagcgaggttggaggtagcgtagtaagaatactggagttgcttaaacgcatttgctcgaaagtcactaccctggatatacattctggccaaaagaaagggggaaaaactccacatttttctcaaatactgagtttcatgaagagaacctccaacaaatggtatataaaggaaaacaaagcaaacaaaagagggaaactttgcaatttattaactcaagcatgaaaatacagaaaataaagagggctcaacatacttggaaaaggaaaaaacatgaagaaaaaacatgatggcattgtttatgaaactaaagaagttctcaatccatctcccaaagtaacacattgttgcaaatcactgtggttaaaatacagttttcagaaggcatacatgacccaacttgtcagctcccagccagttccagccatgtcaaggaacccagatcataatctactttctcagcccaaggagcatagcattgttcagaagcatcaccaggaggaaataattcacaagttggccatgcagctgagacacattggggacaacattgatcataggatg

SEQ ID NO: 280195 - DNA, 395 bp, Homo sapiens
ggcaggcctggaggccgtactgggacctggccaaagacccagaagtccagctttgaagaaaacctggagaaagagagagtcacaaatcatctccatactgcaggagatgcagaaatggcagaagggtagaatacacaataattacagagggaaatgaccaaagatgtcacattttgtgcctgtcttcagtcattccatggcatcaggacatgatcactcttcacttatgacttttgtgtgaacctcccggctcttcacccgcagtttgttcacctgggactcagcaatgtcagcccgttcctcggcctcctccagctcatgctggagcttgcggaatttagctagattggtgttggattgttcctcctgagaataaaaatggaattgtaaggaaa

SEQ ID NO: 280196 - DNA, 2911 bp, Homo sapiens
agcggttgggatttgaatctgccgcggactgcagccggaagtgtcgatccctcagccagggcatggagctctcctgccccggttcgcggtgcccggtgcaagagcagcgtgcccgctgggagcggaaacgcgcctgcaccgcccgggagctgctagagaccgagcggcgctaccaagaacagctggggctggtggccacgtactttttggggatcctgaaagccaaggggaccctgcgaccacctgagcgccaggccctgtttggctcctgggagctcatctacggcgccagccaggagctgcttccctacctggaaggaggatgctggggccaagggctggagggcttctgccgccacttggagctctataaccaatttgctgccaactcagagaggtcccagaccaccctgcaggagcagctaaagaaaaataaaggtttccggaggtttgtacggcttcaggaaggccgccctgagtttgggggccttcagctccaggacctgctccctctgcctctgcaacggctccagcagtatgagaatctcgtcgtagctttggctgaaaacacaggtcccaacagccctgaccatcaacagctcacacctgtccttccctcatgagaagctactgcttatgtccacagaccaggaggagctgtcacgctggtaccacagtctgacttgggctatcagcagccagaaaaactagaggaatcttatagattccagaactcaggatacctcagggataggtcacagccaagagtacaaaggaatcttcagtactgaacaaaacagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacagtgagtgagaccctgtctctatttaagaaaaaataattaagaaattttattaaaaaagaagaatcaggaaaccaagtccaacccaactaaacctcaaatgaaccagcccctaacacagatgaggggatttgggactgataagctctgtgctgtgtccatggcccgtcatttatcaaggctgcagctttgtaaatgtggctatttttatgttgtgtatagtttctatcatttatttttccactggatttgagtaaagttttttttcttttttttgggaaagacccttctgtctcagttttgctatgagaaaagggatttttgggccctgaacgcgggcatgctggtggcctcaggaatacgaggaaaagagctggagctccctctatcttctctgctgtcacactggaaggcagcctctttttgtcctaataaggacagctcttcaagaaggcccagttgtccttaggcacctagtatgggtgtgtacaaccaactaggatcgaaaaaacacacaggagcactccatcatgaaaacagactttgttttagtcgaccttcagctgtcgtccctccttcccagccaaggctgtgactggggccctttgccacagcctggctgcaccttctccgtagtccccgccccacctcccaggaagtagctaggttccatgtctctgtgctccagtttgtgggctcctcccaggcctgactgtcaccaacctcctcctcgtcctcctttaaacagaagtcctcaggaagaggtctgctggcctctgtgtggggagagatcaggaatgttccagtttcagagactttgtctccacctccagcagactcgcctcccgagccttcacctggttctgaagcctccatatccttgtccggcttgctatcttgcagcagctcgtggatggtccatagcttcatgttcagaagctcctgctgggctccagccagagtagtcacactgaagaaatgtccactcagtggctcccaacctatgtccccattcctccctcctgccacaaattccccaaaaattcacagaatcattgctctcctcaccgctcaaaaagggggtccagctgggccatcaggttgttcaggtgctgctctgtctgggccagctgttgtgtcaactgggccagctgttgctctggggataagggaaaaaagggggcagaagtggttatgtatcttctgctgtcccctaaactcccccgacccagcacagacttctgctaaacccacctgactgcagtggctgctgcttgcttgcctcctcgtggagaaccgcagtttcatctttcccctgttgtggaagaaggaaagggcagtactgaagcaacaaggttctgctccatcacctcagtctccagagccagccaagagagagtgcaatttgagatggagacagtgattgggtttttacctcagagaatcacaatcctagtctatctagctcctcacccagcatatgaagcgacgtcctatgtcccacacatggtcagtttgctgaaacacctccaggaatgagcaactccctccggtttgaaaaaagctctggtggctgagtgctgtggctcacacctgtaatcccagcacttcgggaagccaagggcctcctcccaaggagaacatgagaccacttcatatctggaactctagaaacactggctgcagcaatcaacctcctgtgccaaggctggccccactcttgtagcatggacactgctagctgggttcaaatcccagctccagcagttgccagcgctgggtgacctcgagcaagtgactactcctcactggattgtaggagaactaaatgtgatagtcattatttacagttcaccacacgctcttcacatccgttacctccctggatcctcaaaataacctcataatattggaaggccaaaaaaaaaa

SEQ ID NO: 280197 - DNA, 445 bp, Homo sapiens
ctatctcttctagtttcatatatctaaactggttccatcggttctattttataatgcaagtacgtaatagggtcacggctaaagacacagccctggaaggtactgtttttcaaaatgtactgtcaacttacatttcagggcctcctcccaaggagaacatgagaccacttcatatctggaactctagaaacactggctgcagcaatcaacctcctgtgccaaggctggccccactcttgtagcatggacactgctagctgggttcaaatcccagctccagcagttgccagcgctgggtgacctcgagcaagtgactactcctcactggattgtaggagaactaaatgtgatagtcattatttacagttcaccacacgctcttcacatccgttacctccctggatcctcaaaataacctcataatattggaaggccaaaaaaaaaa

SEQ ID NO: 280198 - DNA, 2511 bp, Homo sapiens
agcggttgggatttgaatctgccgcggactgcagccggaagtgtcgatccctcagccagggcatggagctctcctgccccggttcgcggtgcccggtgcaagagcagcgtgcccgctgggagcggaaacgcgcctgcaccgcccgggagctgctagagaccgagcggcgctaccaagaacagctggggctggtggccacgtactttttggggatcctgaaagccaaggggaccctgcgaccacctgagcgccaggccctgtttggctcctgggagctcatctacggcgccagccaggagctgcttccctacctggaaggaggatgctggggccaagggctggagggcttctgccgccacttggagctctataaccaatttgctgccaactcagagaggtcccagaccaccctgcaggagcagctaaagaaaaataaaggtttccggaggtttgtacggcttcaggaaggccgccctgagtttgggggccttcagctccaggacctgctccctctgcctctgcaacggctccagcagtatgagaatctcgtcgtagctttggctgaaaacacaggtcccaacagccctgaccatcaacagctcacacgggctgcccgactgataagtgagactgcccagagagtccatactattggtcagaaacagaagaatgaccagcaccttcggcgtgtccaggctctgctcagtggacgccaggcaaaggggctgacctcagggcgctggttcctacgccagggctggctgttagtggtgcctccccatggggagcctcggccccgcatgttcttcctcttcactgatgtgctcctcatggccaagcctcggcctccactgcacctgctgcggagtggcacctttgcctgcaaggccctctaccccatggcccagtgtcatctcagcagggtctttggccactcaggaggcccttgtgctgtccttccctcatgagaagctactgcttatgtccacagaccaggaggagctgtcacgctggtaccacagtctgacttgggctatcagcagccagaaaaactagaggaatcttatagattccagaactcaggatacctcagggataggtcacagccaagagtacaaaggaatcttcagtactgaacaaaacagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacaaagtcctcaggaagaggtctgctggcctctgtgtggggagagatcaggaatgttccagtttcagagactttgtctccacctccagcagactcgcctcccgagccttcacctggttctgaagcctccatatccttgtccggcttgctatcttgcagcagctcgtggatggtccatagcttcatgttcagaagctcctgctgggctccagccagagtagtcacactgaagaaatgtccactcagtggctcccaacctatgtccccattcctccctcctgccacaaattccccaaaaattcacagaatcattgctctcctcaccgctcaaaaagggggtccagctgggccatcaggttgttcaggtgctgctctgtctgggccagctgttgtgtcaactgggccagctgttgctctggggataagggaaaaaagggggcagaagtggttatgtatcttctgctgtcccctaaactcccccgacccagcacagacttctgctaaacccacctgactgcagtggctgctgcttgcttgcctcctcgtggagaaccgcagtttcatctttcccctgttgtggaagaaggaaagggcagtactgaagcaacaaggttctgctccatcacctcagtctccagagccagccaagagagagtgcaatttgagatggagacagtgattgggtttttacctcagagaatcacaatcctagtctatctagctcctcacccagcatatgaagcgacgtcctatgtcccacacatggtcagtttgctgaaacacctccaggaatgagcaactccctccggtttgaaaaaagctctggtggctgagtgctgtggctcacacctgtaatcccagcacttcgggaagccaagggcctcctcccaaggagaacatgagaccacttcatatctggaactctagaaacactggctgcagcaatcaacctcctgtgccaaggctggccccactcttgtagcatggacactgctagctgggttcaaatcccagctccagcagttgccagcgctgggtgacctcgagcaagtgactactcctcactggattgtaggagaactaaatgtgatagtcattatttacagttcaccacacgctcttcacatccgttacctccctggatcctcaaaataacctcataatattggaaggccaaaaaaaaaa

SEQ ID NO: 280199 - DNA, 1644 bp, Homo sapiens
attagtctaggtacgaggctgggtgtgaagggatttttgggccctgaacgcgggcatgctggtggcctcaggaatacgaggaaaagagctggagctccctctatcttctctgctgtcacactggaaggcagcctctttttgtcctaataaggacagctcttcaagaaggcccagttgtccttaggcacctagtatgggtgtgtacaaccaactaggatcgaaaaaacacacaggagcactccatcatgaaaacagactttgttttagtcgaccttcagctgtcgtccctccttcccagccaaggctgtgactggggccctttgccacagcctggctgcaccttctccgtagtccccgccccacctcccaggaagtagctaggttccatgtctctgtgctccagtttgtgggctcctcccaggcctgactgtcaccaacctcctcctcgtcctcctttaaacagaagtcctcaggaagaggtctgctggcctctgtgtggggagagatcaggaatgttccagtttcagagactttgtctccacctccagcagactcgcctcccgagccttcacctggttctgaagcctccatatccttgtccggcttgctatcttgcagcagctcgtggatggtccatagcttcatgttcagaagctcctgctgggctccagccagagtagtcacactgaagaaatgtccactcagtggctcccaacctatgtccccattcctccctcctgccacaaattccccaaaaattcacagaatcattgctctcctcaccgctcaaaaagggggtccagctgggccatcaggttgttcaggtgctgctctgtctgggccagctgttgtgtcaactgggccagctgttgctctggggataagggaaaaaagggggcagaagtggttatgtatcttctgctgtcccctaaactcccccgacccagcacagacttctgctaaacccacctgactgcagtggctgctgcttgcttgcctcctcgtggagaaccgcagtttcatctttcccctgttgtggaagaaggaaagggcagtactgaagcaacaaggttctgctccatcacctcagtctccagagccagccaagagagagtgcaatttgagatggagacagtgattgggtttttacctcagagaatcacaatcctagtctatctagctcctcacccagcatatgaagcgacgtcctatgtcccacacatggtcagtttgctgaaacacctccaggaatgagcaactccctccggtttgaaaaaagctctggtggctgagtgctgtggctcacacctgtaatcccagcacttcgggaagccaagggcctcctcccaaggagaacatgagaccacttcatatctggaactctagaaacactggctgcagcaatcaacctcctgtgccaaggctggccccactcttgtagcatggacactgctagctgggttcaaatcccagctccagcagttgccagcgctgggtgacctcgagcaagtgactactcctcactggattgtaggagaactaaatgtgatagtcattatttacagttcaccacacgctcttcacatccgttacctccctggatcctcaaaataacctcataatattggaaggccaaaaaaaaaa

SEQ ID NO: 280200 - DNA, 426 bp, Homo sapiens
gtatgagaatctcgtcgtagctttggctgaaaacacaggtcccaacagccctgaccatcaacagctcacacgtaggttcttgctcctcggcaacgcaggctggaggcttcctctcctgtattcctttctgattctgacctccaacaatgtctggtatgaccctatcttccactgacatgtatacagtgtccctactgctctgccttttcttcaagaagtcagaccctgaccctggtcccttccagaataacctctttcacaaccatggcacccaaagtcaaagttgtatggggagtaaggtgggagatgttattccaggggctgcccgactgataagtgagactgcccagagagtccatactattggtcagaaacagaagaatgaccagcaccttcggcgtgtccaggctctgctcagtggacgcc

SEQ ID NO: 280201 - DNA, 3705 bp, Homo sapiens
agcggttgggatttgaatctgccgcggactgcagccggaagtgtcgatccctcagccagggcatggagctctcctgccccggttcgcggtgcccggtgcaagagcagcgtgcccgctgggagcggaaacgcgcctgcaccgcccgggagctgctagagaccgagcggcgctaccaagaacagctggggctggtggccacgtactttttggggatcctgaaagccaaggggaccctgcgaccacctgagcgccaggccctgtttggctcctgggagctcatctacggcgccagccaggagctgcttccctacctggaaggaggatgctggggccaagggctggagggcttctgccgccacttggagctctataaccaatttgctgccaactcagagaggtcccagaccaccctgcaggagcagctaaagaaaaataaaggtttccggaggtttgtacggcttcaggaaggccgccctgagtttgggggccttcagctccaggacctgctccctctgcctctgcaacggctccagcagtatgagaatctcgtcgtagctttggctgaaaacacaggtcccaacagccctgaccatcaacagctcacacgggctgcccgactgataagtgagactgcccagagagtccatactattggtcagaaacagaagaatgaccagcaccttcggcgtgtccaggctctgctcagtggacgccaggcaaaggggctgacctcagggcgctggttcctacgccagggctggctgttagtggtgcctccccatggggagcctcggccccgcatgttcttcctcttcactgatgtgctcctcatggccaagcctcggcctccactgcacctgctgcggagtggcacctttgcctgcaaggccctctaccccatggcccagtgtcatctcagcagggtctttggccactcaggaggcccttgtgctgtccttccctcatgagaagctactgcttatgtccacagaccaggaggagctgtcacgctggtaccacagtctgacttgggctatcagcagccagaaaaactagaggaatcttatagattccagaactcaggatacctcagggataggtcacagccaagagtacaaaggaatcttcagtactgaacaaaacagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacagtgagtgagaccctgtctctatttaagaaaaaataattaagaaattttattaaaaaagaagaatcaggaaaccaagtccaacccaactaaacctcaaatgaaccagcccctaacacagatgaggggatttgggactgataagctctgtgctgtgtccatggcccgtcatttatcaaggctgcagctttgtaaatgtggctatttttatgttgtgtatagtttctatcatttatttttccactggatttgagtaaagttttttttcttttttttgggaaagacccttctgtctcagttttgctatgagaaaagggatttttgggccctgaacgcgggcatgctggtggcctcaggaatacgaggaaaagagctggagctccctctatcttctctgctgtcacactggaaggcagcctctttttgtcctaataaggacagctcttcaagaaggcccagttgtccttaggcacctagtatgggtgtgtacaaccaactaggatcgaaaaaacacacaggagcactccatcatgaaaacagactttgttttagtcgaccttcagctgtcgtccctccttcccagccaaggctgtgactggggccctttgccacagcctggctgcaccttctccgtagtccccgccccacctcccaggaagtagctaggttccatgtctctgtgctccagtttgtgggctcctcccaggcctgactgtcaccaacctcctcctcgtcctcctttaaacagaagtcctcaggaagaggtctgctggcctctgtgtggggagagatcaggaatgttccagtttcagagactttgtctccacctccagcagactcgcctcccgagccttcacctggttctgaagcctccatatccttgtccggcttgctatcttgcagcagctcgtggatggtccatagcttcatgttcagaagctcctgctgggctccagccagagtagtcacactgaagaaatgtccactcagtggctcccaacctatgtccccattcctccctcctgccacaaattccccaaaaattcacagaatcattgctctcctcaccgctcaaaaagggggtccagctgggccatcaggttgttcaggtgctgctctgtctgggccagctgttgtgtcaactgggccagctgttgctctggggataagggaaaaaagggggcagaagtggttatgtatcttctgctgtcccctaaactcccccgacccagcacagacttctgctaaacccacctgactgcagtggctgctgcttgcttgcctcctcgtggagaaccgcagtttcatctttcccctgttgtggaagaaggaaagggcagtactgaagcaacaaggttctgctccatcacctcagtctccagagccagccaagagagagtgcaatttgagatggagacagtgattgggtttttacctcagagaatcacaatcctagtctatctagctcctcacccagcatatgaagcgacgtcctatgtcccacacatggtcagtttgctgaaacacctccaggaatgagcaactccctccggtttgaaaaaagctctggtggctgagtgctgtggctcacacctgtaatcccagcacttcgggaagccaagaaggtgggtggatcacctgaggtcaggagtttgagaccagcctggccaacacggtgaaaccctgtctctattaaaaatacaaaaattagccgggcgtggtggcaggtgcctgtaatcccagttacttgagaggctgaggcaggagaatcgcttgaacctgggagccagaggttgcagtgagccgagattgcgccgctgcactccagcctgggtgacagagcgagactccatctcgaaaaaaacaaaaactttggttgttagacagttcatgcacaaagccaaaatttgtcctttatgtatcttctttccatagtgcttactggagccttccaaaataatgtctcctcaaggtgacagcccctcaggaatttgaaggcaatggtcacaccctcacccactttcctgagttttttctggtttattaacgtcagtctttacagtcagtgctcattgacggtggttttctctggttgtttcctgaacacgtagtgctcttaaagcaatgccctgaggagaatacaattctccaggggcattctgattggcaggtgaagcacagtgccatgttcccagcactgatttgggaagtggcttgtcacatcccacagtgaactcagtcaactggaatgcctaactctctttcataagacctcctgctacattatgtttctcccagactgtactcaggtccaagaacagaatttactagtctatccttctcaaagttcatcattaaattcagtcattcatcctagc

SEQ ID NO: 280202 - DNA, 2394 bp, Homo sapiens
agcggttgggatttgaatctgccgcggactgcagccggaagtgtcgatccctcagccagggcatggagctctcctgccccggttcgcggtgcccggtgcaagagcagcgtgcccgctgggagcggaaacgcgcctgcaccgcccgggagctgctagagaccgagcggcgctaccaagaacagctggggctggtggccacgtactttttggggatcctgaaagccaaggggaccctgcgaccacctgagcgccaggccctgtttggctcctgggagctcatctacggcgccagccaggagctgcttccctacctggaaggaggatgctggggccaagggctggagggcttctgccgccacttggagctctataaccaatttgctgccaactcagagaggtcccagaccaccctgcaggagcagctaaagaaaaataaaggtttccggaggtttgtacggcttcaggaaggccgccctgagtttgggggccttcagctccaggacctgctccctctgcctctgcaacggctccagcagtatgagaatctcgtcgtagctttggctgaaaacacaggtcccaacagccctgaccatcaacagctcacacgggctgcccgactgataagtgagactgcccagagagtccatactattggtcagaaacagaagaatgaccagcaccttcggcgtgtccaggctctgctcagtggacgccaggcaaaggggctgacctcagggcgctggttcctacgccagggctggctgttagtggtgcctccccatggggagcctcggccccgcatgttcttcctcttcactgatgtgctcctcatggccaagcctcggcctccactgcacctgctgcggagtggcacctttgcctgcaaggccctctaccccatggcccagtgtcatctcagcagggtctttggccactcaggaggcccttgtgctgtccttccctcatgagaagctactgcttatgtccacagaccaggaggagctgtcacgctggtaccacagtctgacttgggctatcagcagccagaaaaactagaggaatcttatagattccagaactcaggatacctcagggataggtcacagccaagagtacaaaggaatcttcagtactgaacaaaacagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacaaagtcctcaggaagaggtctgctggcctctgtgtggggagagatcaggaatgttccagtttcagagactttgtctccacctccagcagactcgcctcccgagccttcacctggttctgaagcctccatatccttgtccggcttgctatcttgcagcagctcgtggatggtccatagcttcatgttcagaagctcctgctgggctccagccagagtagtcacactgaagaaatgtccactcagtggctcccaacctatgtccccattcctccctcctgccacaaattccccaaaaattcacagaatcattgctctcctcaccgctcaaaaagggggtccagctgggccatcaggttgttcaggtgctgctctgtctgggccagctgttgtgtcaactgggccagctgttgctctggggataagggaaaaaagggggcagaagtggttatgtatcttctgctgtcccctaaactcccccgacccagcacagacttctgctaaacccacctgactgcagtggctgctgcttgcttgcctcctcgtggagaaccgcagtttcatctttcccctgttgtggaagaaggaaagggcagtactgaagcaacaaggttctgctccatcacctcagtctccagagccagccaagagagagtgcaatttgagatggagacagtgattgggtttttacctcagagaatcacaatcctagtctatctagctcctcacccagcatatgaagcgacgtcctatgtcccacacatggtcagtttgctgaaacacctccaggaatgagcaactccctccggtttgaaaaaagctctggtggctgagtgctgtggctcacacctgtaatcccagcacttcgggaagccaaggctgagacaggagaatcacgggaacctgggaggtggaggttgcagtaagccgaaatcgtgccactgcactccagcctgggcaaacgagtgagacaccgcctcagaaaaacaaaacaaaaacaaaacctgccttctgggattgggcttctggttttttgcccatgacacacacatcctttcctattttgtg

SEQ ID NO: 280203 - DNA, 1658 bp, Homo sapiens
agcggttgggatttgaatctgccgcggactgcagccggaagtgtcgatccctcagccagggcatggagctctcctgccccggttcgcggtgcccggtgcaagagcagcgtgcccgctgggagcggaaacgcgcctgcaccgcccgggagctgctagagaccgagcggcgctaccaagaacagctggggctggtggccacgtactttttggggatcctgaaagccaaggggaccctgcgaccacctgagcgccaggccctgtttggctcctgggagctcatctacggcgccagccaggagctgcttccctacctggaaggaggatgctggggccaagggctggagggcttctgccgccacttggagctctataaccaatttgctgccaactcagagaggtcccagaccaccctgcaggagcagctaaagaaaaataaaggtttccggaggtttgtacggcttcaggaaggccgccctgagtttgggggccttcagctccaggacctgctccctctgcctctgcaacggctccagcagtatgagaatctcgtcgtagctttggctgaaaacacaggtcccaacagccctgaccatcaacagctcacacgggctgcccgactgataagtgagactgcccagagagtccatactattggtcagaaacagaagaatgaccagcaccttcggcgtgtccaggctctgctcagtggacgccaggcaaaggggctgacctcagggcgctggttcctacgccagggctggctgttagtggtgcctccccatggggagcctcggccccgcatgttcttcctcttcactgatgtgctcctcatggccaagcctcggcctccactgcacctgctgcggagtggcacctttgcctgcaaggccctctaccccatggcccagtgtcatctcagcagggtctttggccactcaggaggcccttgtgctgtccttccctcatgagaagctactgcttatgtccacagaccaggaggagctgtcacgctggtaccacagtctgacttgggctatcagcagccagaaaaactagaggaatcttatagattccagaactcaggatacctcagggataggtcacagccaagagtacaaaggaatcttcagtactgaacaaaacagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacagtgagtgagaccctgtctctatttaagaaaaaataattaagaaattttattaaaaaagaagaatcaggaaaccaagtccaacccaactaaacctcaaatgaaccagcccctaacacagatgaggggatttgggactgataagctctgtgctgtgtccatggcccgtcatttatcaaggctgcagctttgtaaatgtggctatttttatgttgtgtatagtttctatcatttatttttccactggatttgagtaaagttttttttcttttttttttttttttttttttttttttttttttttttttttttttttttttttttatttttt

SEQ ID NO: 280204 - DNA, 1307 bp, Homo sapiens
ttgacccagcctcaccaggccgggcccctctgctcaggaccaggccccaccccagtgccgccctgaggcctggcaggggcctctggagcccgcacacccctctccttggcagccccctccatcctgggcccttcgtctttcccacaggtgtgtccctcaggactttgcagccagggtgtggccggccgcaggtttcggatgcaggcggccggatcgtggggggtcacgctgccccggccggcgcatggccatggcaggccagcctccgcctgcggaggatgcacgtgtgcggcgggtcactgctcagcccccagtgggtgctcacagctgcccactgcttctccgggtccctgaactcatccgactaccaggtgcacctgggggaactggagatcactttgtctccccacttctccaccgtgaggcagatcatcctgcactccagcccctcaggacagccggggaccaccggatcctgcccgtctgcctcccggaggcctcagatgacttctgccctgggatccggtgctcggtgaccggctggggctatacgcgggagggagagcctctgccacccccgtacagcctgcgggaggtgaaagtctccgtggtggacacagagacctgccgccgggactatcccggccccgggggcagcatccttcagcccgacatgctgtgtgcccggggccccggggatgcctgccaggacgactccggggggcctctggtctgccaggtgaacggtgcctgggtgcaggctggcattgtgagctggggtgagggctgcggccgccccaacaggccgggagtctacactcgtgtccctgcctacgtgaactggatccgccgccacatcacagcatcagggggctcagagtctgggtaccccaggctccccctcctggctggcttcttcctccccggcctcttccttctgctagtctcctgtgtcctgctggccaagtgcctgctgcacccatctgcggatggtactcccttccccgcccctgactgatggcaggaatccaagtgcatttcttaaataagttactatttattccgctccgccccctccctctcccttgagaagctgagtcttctgcatcagattattgcaacatttaacctgaatttaaaagcacacgaaacaaaggtgtcaatgggaatctcgcggccaacgcccccagatgtaggggaggcctgatacgcatcggggccgggcgcgttactccatggggtcggccccttagtgaggtgtcacctctcccagagtcacaggacgcttctgggaaggcccgagcgga

SEQ ID NO: 280205 - DNA, 1154 bp, Homo sapiens
ttgacccagcctcaccaggccgggcccctctgctcaggaccaggccccaccccagtgccgccctgaggcctggcaggggcctctggagcccgcacacccctctccttggcagccccctccatcctgggcccttcgtctttcccacaggtgtgtccctcaggactttgcagccagggtgtggccggccgcaggtttcggatgcaggcggccggatcgtggggggtcacgctgccccggccggcgcatggccatggcaggccagcctccgcctgcggaggatgcacgtgtgcggcgggtcactgctcagcccccagtgggtgctcacagctgcccactgcttctccgggtccctgaactcatccgactaccaggtgcacctgggggaactggagatcactttgtctccccacttctccaccgtgaggcagatcatcctgcactccagcccctcaggacagccggggaccaccggatcctgcccgtctgcctcccggaggcctcagatgacttctgccctgggatccggtgctcggtgaccggctggggctatacgcgggagggagagcctctgccacccccgtacagcctgcgggaggtgaaagtctccgtggtggacacagagacctgccgccgggactatcccggccccgggggcagcatccttcagcccgacatgctgtgtgcccggggccccggggatgcctgccaggacgactccggggggcctctggtctgccaggtgaacggtgcctgggtgcaggctggcattgtgagctggggtgagggctgcggccgccccaacaggccgggagtctacactcgtgtccctgcctacgtgaactggatccggttccagcgtccactccgacagccactgcaggcaggggccctctgccctctgccgggagggcctgcaatgaattacatgtgattggccacatacaaagggatcgctgttctgcgagcagggagccagcctgtcagattgcctccgcgagcagtcacgaatccagggcaaaactgcagctgacatttaattcaaaaatcaaaggttgttcaatgtagggggaaaaaaagccatgctactgtaataagggaagccagcaggaggctctgcgggaaggaagggaattttaaaatcggccctcgtgccg

SEQ ID NO: 280206 - DNA, 1332 bp, Homo sapiens
ccgggcaggtattcaagtgattctcccatctcggtctcctgagtagctgggactacaggtgcatgccactaagccccatggcccttggggcctgtggcctcctgctgctcctggctgtgcccggtgtgtccctcaggactttgcagccagggtgtggccggccgcaggtttcggatgcaggcggccggatcgtggggggtcacgctgccccggccggcgcatggccatggcaggccagcctccgcctgcggaggatgcacgtgtgcggcgggtcactgctcagcccccagtgggtgctcacagctgcccactgcttctccgggtccctgaactcatccgactaccaggtgcacctgggggaactggagatcactttgtctccccacttctccaccgtgaggcagatcatcctgcactccagcccctcaggacagccggggaccagcggggacatcgccctggtggagctcagtgtccccgtgaccctctccagccggatcctgcccgtctgcctcccggaggcctcagatgacttctgccctgggatccggtgctcggtgaccggctggggctatacgcgggagggagagcctctgccacccccgtacagcctgcgggaggtgaaagtctccgtggtggacacagagacctgccgccgggactatcccggccccgggggcagcatccttcagcccgacatgctgtgtgcccggggccccggggatgcctgccaggacgactccggggggcctctggtctgccaggtgaacggtgcctgggtgcaggctggcattgtgagctggggtgagggctgcggccgccccaacaggccgggagtctacactcgtgtccctgcctacgtgaactggatccgccgccacatcacagcatcagggggctcagagtctgggtaccccaggctccccctcctggctggcttcttcctccccggcctcttccttctgctagtctcctgtgtcctgctggccaagtgcctgctgcacccatctgcggatggtactcccttccccgcccctgactgatggcaggaatccaagtgcatttcttaaataagttactatttattccgctccgccccctccctctcccttgagaagctgagtcttctgcatcagattattgcaacatttaacctgaatttaaaagcacacgaaacaaaggtgtcaatgggaatctcgcggccaacgcccccagatgtaggggaggcctgatacgcatcggggccgggcgcgttactccatggggtcggccccttagtgaggtgtcacctctcccagagtcacaggacgcttctgggaaggcccgagcgga

SEQ ID NO: 280207 - DNA, 7751 bp, Homo sapiens
gggagcccacagcgtctctgtgacttggcaggacccagctccactgaatcagagtccagaaaaagatcaatttcaaaaagaaagtctcatctggatctcctcaaactcatcatggatggcatgaccgaagcatgcatcaagggtggcatcgaagcttgctatgcagccgtgtcctgtgtctgcaccttgctgggtgccctggatgagctcagccaggggaagggcttgagcgaaggtcaggtgcaactgctgcttctgcgccttgaggagctgaaggatggggctgagtggagccgagattccatggagatcaatgaggctgacttccgctggcagcggcgagtgctgtcctcagaacacacgccgtgggagtcagggaacgagaggagccttgacatcagcatcagtgtcaccacagacacaggccagaccactctcgagggagagttgggtcagactacacccgaggaccattcgggaaaccacaagaacagtctcaagtcgccagccatcccagagggtaaggagacgctgagcaaagtattggaaacagaggcggtagaccagccagatgtcgtgcagagaagccacacggtcccttaccctgacataactaacttcctgtcagtagactgcaggacaaggtcctatggatctaggtatagtgagagcaattttagcgttgatgaccaagacctttctaggacagagtttgattcctgtgatcagtactctatggcagcagaaaaggactcgggcaggtccgacgtgtcagacattgggtcggacaactgttcactagccgatgaagagcagacaccccgggactgcctaggccaccggtccctgcgaactgccgccctgtctctaaaactgctgaagaaccaggaggcggatcagcacagcgccaggctgttcatacagtccctggaaggcctcctccctcggctcctgtctctctccaatgtagaggaggtggacaccgctctgcagaactttgcctctactttctgctcaggcatgatgcactctcctggctttgacgggaatagcagcctcagcttccagatgctgatgaacgcagacagcctctacacagctgcacactgcgccctgctcctcaacctgaagctctcccacggtgactactacaggaagcggccgaccctggcgccaggcgtgatgaaggacttcatgaagcaggtgcagaccagcggcgtgctgatggtcttctctcaggcctggattgaggagctctaccatcaggtgctcgacaggaacatgcttggagaggctggctattggggcagcccagaagataacagccttcccctcatcacaatgctgaccgatattgacggcttagagagcagtgccattggtggccagctgatggcctcggctgctacagagtctcctttcgcccagagcaggagaattgatgactccacagtggcaggcgtggcatttgctcgctatattctggtgggctgctggaagaacttgatcgatactttatcaaccccactgactggtcgaatggcggggagctccaaagggctggccttcattctgggagctgaaggcatcaaagagcagaaccagaaggagcgggacgccatctgcatgagcctcgacgggctgcggaaagccgcacggctgagctgcgctctaggcgttgctgctaactgcgcctcagcccttgcccagatggcagctgcctcctgtgtccaagaagaaaaagaagagagggaggcccaagaacccagtgatgccatcacacaagtgaaactaaaagtggagcagaaactggagcagattgggaaggtgcagggggtgtggctgcacactgcccacgtcttgtgcatggaggccatcctcagcgtaggcctggagatgggaagccacaacccggactgctggccacacgtgttcagggtgtgtgaatacgtgggcaccctggagcacaaccacttcagcgatggtgcctcgcagccccctctgaccatcagccagccccagaaggccactggaagcgctggcctccttggggaccccgagtgtgagggctcgccccccgagcacagcccggagcaggggcgctccctgagcacggcccctgtcgtccagcccctgtccatccaggacctcgtccgggaaggcagccggggtcgggcctccgacttccgcggcgggagcctcatgagcgggagcagcgcggccaaggtggtgctcaccctctccacgcaagccgacaggctctttgaagatgctacggataagttgaacctcatggccttgggaggttttctttaccagctgaagaaagcatcgcagtctcagcttttccattctgttacagatacagttgattactctctggcaatgccaggagaagttaaatccactcaagaccgaaaaagcgccctccacctgttccgcctggggaatgccatgctgaggattgtgcggagcaaagcacggcccctgctccacgtgatgcgctgctggagccttgtggccccacacctggtggaggctgcttgccataaggaaagacatgtgtctcagaaggctgtttccttcatccatgacatactgacagaagtcctcactgactggaatgagccacctcattttcacttcaatgaagcactcttccgacctttcgagcgcattatgcagctggaattgtgtgatgaggacgtccaagaccaggttgtcacatccattggtgagctggttgaagtgtgttccacgcagatccagtcgggatggagacccttgttcagtgccctggaaacagtgcatggcgggaacaagtcagagatgaaggagtacctggttggtgactactccatgggaaaaggccaagctccagtgtttgatgtatttgaagcttttctcaatactgacaacatccaggtctttgctaatgcagccactagctacatcatgtgccttatgaagtttgtcaaaggactgggggaggtggactgtaaagagattggagactgtgccccagcacccggagccccgtccacagacctgtgcctcccggccctggattacctcaggcgctgctctcagttattggccaaaatctacaaaatgcccttgaagccaatattccttagtgggagacttgccggcttgcctcgaagacttcaggaacagtcagccagcagtcacaggagggaattgaatcagtcctgtctgattttgatgatgacaccggtctgatagaagtctggataatcctgctggagcagctgacagcggctgtgtccaattgtccacggcagcaccaaccaccaactctggatttactctttgagctgttgagagatgtgacgaaaacaccaggaccagggtttggtatctatgcagtggttcacctcctccttcctgtgatgtccgtttggctccgccggagccataaagaccattcctactgggatatggcctctgccaatttcaagcacgctattggtctgtcctgtgagctggtggtggagcacattcaaagctttctacattcagatatcaggtacgagagcatgatcaataccatgctgaaggacctctttgagttgctggtcgcctgtgtggccaagcccactgaaaccatctccagagtgggctgctcctgtattagatacgtccttgtgacagcgggccctgtgttcactgaggagatgtggaggcttgcctgctgtgccctgcaagatgcgttctctgccacactcaagccagtgaaggacctgctgggctgcttccacagcggcacggagagcttcagcggggaaggctgccaggtgcgagtggcggccccgtcctcctccccaagtgccgaggccgagtactggcgcatccgagccatggcccagcaggtgtttatgctggacacccagtgctcaccaaagacaccaaacaactttgaccacgctcagtcctgccagctcattattgagctgcctcctgatgaaaaaccaaatggacacaccaagaaaagcgtgtctttcagggaaattgtggtgagcctgctgtctcatcaggtgttactccagaacttatatgacatcttgttagaagagtttgtcaaaggcccctctcctggagaggaaaagacgatacaagtgccagaagccaagctggctggcttcctcagatacatctctatgcagaacttggcagtcatattcgacctgctgctggactcttataggactgccagggagtttgacaccagccccgggctgaagtgcctgctgaagaaagtgtctggcatcgggggcgccgccaacctctaccgccagtctgcgatgagctttaacatttatttccacgccctggtgtgtgctgttctcaccaatcaagaaaccatcacggccgagcaagtgaagaaggtcctttttgaggacgacgagagaagcacggattcttcccagcagtgttcatctgaggatgaagacatctttgaggaaaccgcccaggtcagccccccgagaggcaaggagaagagacagtggcgggcacggatgcccttgctcagcgtccagcctgtcagcaacgcagattgggtgtggctggtcaagaggctgcacaagctgtgcatggaactgtgcaacaactacatccagatgcacttggacctggagaactgtatggaggagcctcccatcttcaagggcgacccgttcttcatcctgccctccttccagtccgagtcatccaccccatccaccgggggcttctctgggaaagaaaccccttccgaggatgacagaagccagtcccgggagcacatgggcgagtccctgagcctgaaggccggtggtggggacctgctgctgccccccagccccaaagtggagaagaaggatcccagccggaagaaggagtggtgggagaatgcggggaacaaaatctacaccatggcagccgacaagaccatttcaaagttgatgaccgaatacaaaaagaggaaacagcagcacaacctgtccgcgttccccaaagaggtcaaagtggagaagaaaggagagccactgggtcccaggggccaggactccccgctgcttcagcgtccccagcacttgatggaccaagggcaaatgcggcattccttcagcgcaggccccgagctgctgcgacaggacaagaggccccgctcaggctccaccgggagctccctcagtgtctcggtgagagacgcagaagcacagatccaggcatggaccaacatggtgctaacagttctcaatcagattcagattctcccagaccagaccttcacggccctccagcccgcagtgttcccgtgcatcagtcagctgacctgtcacgtgaccgacatcagagttcgccaggctgtgagggagtggctgggcagggtgggccgtgtctatgacatcattgtgtagccgactcctgttctactctcccaccaaataacagtagtgagggttagagtcctgccaatacagctgttgcattttccccaccactagccccacttaaactactactactgtctcagagaacagtgtttcctaatgtaaaaagcctttccaaccactgatcagcattggggccatactaaggtttgtatctagatgacacaaacgatattctgattttgcacattattatagaagaatctataatccttgatatgtttctaactcttgaagtatatttcccagtgcttttgcttacagtgttgtccccaaatgggtcattttcaaggattactcatttgaaaacactatattgatccatttgatccatcatttaaaaaataaatacaattcctaaggcaatatctgctggtaagtcaagctgataaacactcagacatctagtaccagggattattaattggaggaagatttatggttatgggtctggctgggaagaagacaactataaatacatattcttgggtgtcataatcaagaaagaggtgacttctgttgtaaaataatccagaacacttcaaaattattcctaaatcattaagattttcaggtattcaccaatttccccatgtaaggtactgtgttgtacctttatttctgtatttctaaaagaagaaagttctttcctagcagggtttgaagtctgtggcttatcagcctgtgacacagagtacccagtgaaagtggctggtacgtagattgtcaagagacataagaccgaccagccaccctggctgttcttgtggtgtttgtttccatccccaaggcaaacaaggaaaggaaaggaaagaagaaaaggtgccttagtcctttgttgcacttccatttccatgccccacaattgtctgaacataaggtatagcatttggtttttaagaaaacaaaacattaagacgcaactcattttatatcaacacgcttggaggaaagggactcagggaagggagcagggagtgtggggtggggatggattatgatgaaatcattttcaatcttaaaatataatacaacaatcttgcaaaattatggtgtcagttacacaagctctagtctcaaaatgaaagtaatggagaaagacactgaaatttagaaaattttgtcgatttaaaatatttctcctatctaccaagtaaagttaccctatgtttgatgtctttgcattcagaccaatatttcaggtggatatttctaagtattactagaaaatacgtttgaaagctttatcttattatttacagtatttttatatttcttacattatcctaatgattgaaaactcctcaatcaagcttacttacacacattctacagagttatttaaggcatacattataatctcccagccccattcataatgaataagtcaccctttaaatataagacacaaattctacagtattgaaataaggatttaaaggggtatttgtaaactttgccctccttgagaaatatggaactaccttagaggttaagaggaaggcagtgttctgacttctttaggtgatctgaaaaaaacacccttatcatccagtgtaccatctagagatcaccacagaatccatttttttcccagttccacaaaacactctgtttgccttcagtttttactcactagacaataattcaagtttagaaacaggtaatcagctatttgatcttaaaaggcaatgaattgttgggatatcagtgaactatgttgtatacttttgaatttttacattttataaatggaattgaaagttggataactgctttttttaaattttccaacagaagtaacaccacagttgctttgtttctttttatagcttacctgaggttcagttcttctttgtgaacctgtgagtactccacagtttactgggggaaaaggcttcagtaaagcagaggctagaattacagtatttatacatagcaacttttcataaagtagaaaaattcaaaggaagctgtctcaatttgagaataccagctgggcacggtggctcacgcctgtaatcccagcacttactttgggaggccaaggtgggcagataacctgcggtcaggagtttgagaccaggctggacaacatggtgaaacctcgtctctactaaaaatacaaaaattagccaggtgtggtaggatgcacctgtaatcccagctacttaggaggccgagacaggagaatcgctcgaacccaggaggcggacgttgcagtgagccaagattgcaccattgcactccagactgggtgacaagagtgaaactccatctaaaaaaaaaaaa

SEQ ID NO: 280208 - DNA, 5993 bp, Homo sapiens
gggagcccacagcgtctctgtgacttggcaggacccagctccactgaatcagagtccagaaaaagatcaatttcaaaaagaaagtctcatctggatctcctcaaactcatcatggatggcatgaccgaagcatgcatcaagggtggcatcgaagcttgctatgcagccgtgtcctgtgtctgcaccttgctgggtgccctggatgagctcagccaggggaagggcttgagcgaaggtcaggtgcaactgctgcttctgcgccttgaggagctgaaggatggggctgagtggagccgagattccatggagatcaatgaggctgacttccgctggcagcggcgagtgctgtcctcagaacacacgccgtgggagtcagggaacgagaggagccttgacatcagcatcagtgtcaccacagacacaggccagaccactctcgagggagagttgggtcagactacacccgaggaccattcgggaaaccacaagaacagtctcaagtcgccagccatcccagagggtaaggagacgctgagcaaagtattggaaacagaggcggtagaccagccagatgtcgtgcagagaagccacacggtcccttaccctgacataactaacttcctgtcagtagactgcaggacaaggtcctatggatctaggtatagtgagagcaattttagcgttgatgaccaagacctttctaggacagagtttgattcctgtgatcagtactctatggcagcagaaaaggactcgggcaggtccgacgtgtcagacattgggtcggacaactgttcactagccgatgaagagcagacaccccgggactgcctaggccaccggtccctgcgaactgccgccctgtctctaaaactgctgaagaaccaggaggcggatcagcacagcgccaggctgttcatacagtccctggaaggcctcctccctcggctcctgtctctctccaatgtagaggaggtggacaccgctctgcagaactttgcctctactttctgctcaggcatgatgcactctcctggctttgacgggaatagcagcctcagcttccagatgctgatgaacgcagacagcctctacacagctgcacactgcgccctgctcctcaacctgaagctctcccacggtgactactacaggaagcggccgaccctggcgccaggcgtgatgaaggacttcatgaagcaggtgcagaccagcggcgtgctgatggtcttctctcaggcctggattgaggagctctaccatcaggtgctcgacaggaacatgcttggagaggctggctattggggcagcccagaagataacagccttcccctcatcacaatgctgaccgatattgacggcttagagagcagtgccattggtggccagctgatggcctcggctgctacagagtctcctttcgcccagagcaggagaattgatgactccacagtggcaggcgtggcatttgctcgctatattctggtgggctgctggaagaacttgatcgatactttatcaaccccactgactggtcgaatggcggggagctccaaagggctggccttcattctgggagctgaaggcatcaaagagcagaaccagaaggagcgggacgccatctgcatgagcctcgacgggctgcggaaagccgcacggctgagctgcgctctaggcgttgctgctaactgcgcctcagcccttgcccagatggcagctgcctcctgtgtccaagaagaaaaagaagagagggaggcccaagaacccagtgatgccatcacacaagtgaaactaaaagtggagcagaaactggagcagattgggaaggtgcagggggtgtggctgcacactgcccacgtcttgtgcatggaggccatcctcagcgtaggcctggagatgggaagccacaacccggactgctggccacacgtgttcagggtgtgtgaatacgtgggcaccctggagcacaaccacttcagcgatggtgcctcgcagccccctctgaccatcagccagccccagaaggccactggaagcgctggcctccttggggaccccgagtgtgagggctcgccccccgagcacagcccggagcaggggcgctccctgagcacggcccctgtcgtccagcccctgtccatccaggacctcgtccgggaaggcagccggggtcgggcctccgacttccgcggcgggagcctcatgagcgggagcagcgcggccaaggtggtgctcaccctctccacgcaagccgacaggctctttgaagatgctacggataagttgaacctcatggccttgggaggttttctttaccagctgaagaaagcatcgcagtctcagcttttccattctgttacagatacagttgattactctctggcaatgccaggagaagttaaatccactcaagaccgaaaaagcgccctccacctgttccgcctggggaatgccatgctgaggattgtgcggagcaaagcacggcccctgctccacgtgatgcgctgctggagccttgtggccccacacctggtggaggctgcttgccataaggaaagacatgtgtctcagaaggctgtttccttcatccatgacatactgacagaagtcctcactgactggaatgagccacctcattttcacttcaatgaagcactcttccgacctttcgagcgcattatgcagctggaattgtgtgatgaggacgtccaagaccaggttgtcacatccattggtgagctggttgaagtgtgttccacgcagatccagtcgggatggagacccttgttcagtgccctggaaacagtgcatggcgggaacaagtcagagatgaaggagtacctggttggtgactactccatgggaaaaggccaagctccagtgtttgatgtatttgaagcttttctcaatactgacaacatccaggtctttgctaatgcagccactagctacatcatgtgccttatgaagtttgtcaaaggactgggggaggtggactgtaaagagattggagactgtgccccagcacccggagccccgtccacagacctgtgcctcccggccctggattacctcaggcgctgctctcagttattggccaaaatctacaaaatgcccttgaagccaatattccttagtgggagacttgccggcttgcctcgaagacttcaggaacagtcagccagcagtcacaggagggaattgaatcagtcctgtctgattttgatgatgacaccggtctgatagaagtctggataatcctgctggagcagctgacagcggctgtgtccaattgtccacggcagcaccaaccaccaactctggatttactctttgagctgttgagagatgtgacgaaaacaccaggaccagggtttggtatctatgcagtggttcacctcctccttcctgtgatgtccgtttggctccgccggagccataaagaccattcctactgggatatggcctctgccaatttcaagcacgctattggtctgtcctgtgagctggtggtggagcacattcaaagctttctacattcagatatcaggtacgagagcatgatcaataccatgctgaaggacctctttgagttgctggtcgcctgtgtggccaagcccactgaaaccatctccagagtgggctgctcctgtattagatacgtccttgtgacagcgggccctgtgttcactgaggagatgtggaggcttgcctgctgtgccctgcaagatgcgttctctgccacactcaagccagtgaaggacctgctgggctgcttccacagcggcacggagagcttcagcggggaaggctgccaggtgcgagtggcggccccgtcctcctccccaagtgccgaggccgagtactggcgcatccgagccatggcccagcaggtgtttatgctggacacccagtgctcaccaaagacaccaaacaactttgaccacgctcagtcctgccagctcattattgagctgcctcctgatgaaaaaccaaatggacacaccaagaaaagcgtgtctttcagggaaattgtggtgagcctgctgtctcatcaggtgttactccagaacttatatgacatcttgttagaagagtttgtcaaaggcccctctcctggagaggaaaagacgatacaagtgccagaagccaagctggctggcttcctcagatacatctctatgcagaacttggcagtcatattcgacctgctgctggactcttataggactgccagggagtttgacaccagccccgggctgaagtgcctgctgaagaaagtgtctggcatcgggggcgccgccaacctctaccgccagtctgcgatgagctttaacatttatttccacgccctggtgtgtgctgttctcaccaatcaagaaaccatcacggccgagcaagtgaagaaggtcctttttgaggacgacgagagaagcacggattcttcccagcagtgttcatctgaggatgaagacatctttgaggaaaccgcccaggtcagccccccgagaggcaaggagaagagacagtggcgggcacggatgcccttgctcagcgtccagcctgtcagcaacgcagattgggtgtggctggtcaagaggctgcacaagctgtgcatggaactgtgcaacaactacatccagatgcacttggacctggagaactgtatggaggagcctcccatcttcaagggcgacccgttcttcatcctgccctccttccagtccgagtcatccaccccatccaccgggggcttctctgggaaagaaaccccttccgaggatgacagaagccagtcccgggagcacatgggcgagtccctgagcctgaaggccggtggtggggacctgctgctgccccccagccccaaagtggagaagaaggatcccagccggaagaaggagtggtgggagaatgcggggaacaaaatctacaccatggcagccgacaagaccatttcaaagttgatgaccgaatacaaaaagaggaaacagcagcacaacctgtccgcgttccccaaagaggtcaaagtggagaagaaaggagagccactgggtcccaggggccaggactccccgctgcttcagcgtccccagcacttgatggaccaagggcaaatgcggcattccttcagcgcaggccccgagctgctgcgacaggacaagaggccccgctcaggctccaccgggagctccctcagtgtctcggtgagagacgcagaagcacagatccaggcatggaccaacatggtgctaacagttctcaatcagattcagattctcccagaccagaccttcacggccctccagcccgcagtgttcccgtgcatcagtcagctgacctgtcacgtgaccgacatcagagttcgccaggctgtgagggagtggctgggcagggtgggccgtgtctatgacatcattgtgtagccgactcctgttctactctcccaccaaataacagtagtgagggttagagtcctgccaatacagctgttgcattttccccaccactagccccacttaaactactactactgtctcagagaacagtgtttcctaatgtaaaaagcctttccaaccactgatcagcattggggccatactaaggtttgtatctagatgacacaaacgatattctgattttgcacattattatagaagaatctataatccttgatatgtttctaactcttgaagtatatttcccagtgcttttgcttacagtgttgtccccaaatgggtcattttcaaggattactcatttgaaaacactatattgatccatttgatccatcatttaaaaaataaatacaattcctaaggcaatatctgctggtaagtcaagctgataaacactcagacatctagtaccagggattattaattggaggaagatttatggttatgggtctggctgggaagaagacaactataaatcttcctccaattaatactccctggtcctagacgcctgagtgtttaccagctgtcgac

SEQ ID NO: 280209 - DNA, 356 bp, Homo sapiens
gctgtgcctgacccagagcccatgaaagggcctggaaggaatggcacctgccagctcaggatccatcccacttctggagctggagagctggggccaccagcacgtgggacctgctggctgggtggtttgcatgatggtccgcaaggacctactgtggaggtgcttgctgccactgaagtctgtcctttcccttttgcccttgcatgacacacattctttcattttcattctttctgtctcccttactcaacctgttattttaataaatgtctttctggcacagtgaaactaaaagtggagcagaaactggagcagattgggaaggtgcagggggtgtggctgcacactgcccacgt

SEQ ID NO: 280210 - DNA, 6296 bp, Homo sapiens
gggagcccacagcgtctctgtgacttggcaggacccagctccactgaatcagagtccagaaaaagatcaatttcaaaaagaaagtctcatctggatctcctcaaactcatcatggatggcatgaccgaagcatgcatcaagggtggcatcgaagcttgctatgcagccgtgtcctgtgtctgcaccttgctgggtgccctggatgagctcagccaggggaagggcttgagcgaaggtcaggtgcaactgctgcttctgcgccttgaggagctgaaggatggggctgagtggagccgagattccatggagatcaatgaggctgacttccgctggcagcggcgagtgctgtcctcagaacacacgccgtgggagtcagggaacgagaggagccttgacatcagcatcagtgtcaccacagacacaggccagaccactctcgagggagagttgggtcagactacacccgaggaccattcgggaaaccacaagaacagtctcaagtcgccagccatcccagagggtaaggagacgctgagcaaagtattggaaacagaggcggtagaccagccagatgtcgtgcagagaagccacacggtcccttaccctgacataactaacttcctgtcagtagactgcaggacaaggtcctatggatctaggtatagtgagagcaattttagcgttgatgaccaagacctttctaggacagagtttgattcctgtgatcagtactctatggcagcagaaaaggactcgggcaggtccgacgtgtcagacattgggtcggacaactgttcactagccgatgaagagcagacaccccgggactgcctaggccaccggtccctgcgaactgccgccctgtctctaaaactgctgaagaaccaggaggcggatcagcacagcgccaggctgttcatacagtccctggaaggcctcctccctcggctcctgtctctctccaatgtagaggaggtggacaccgctctgcagaactttgcctctactttctgctcaggcatgatgcactctcctggctttgacgggaatagcagcctcagcttccagatgctgatgaacgcagacagcctctacacagctgcacactgcgccctgctcctcaacctgaagctctcccacggtgactactacaggaagcggccgaccctggcgccaggcgtgatgaaggacttcatgaagcaggtgcagaccagcggcgtgctgatggtcttctctcaggcctggattgaggagctctaccatcaggtgctcgacaggaacatgcttggagaggctggctattggggcagcccagaagataacagccttcccctcatcacaatgctgaccgatattgacggcttagagagcagtgccattggtggccagctgatggcctcggctgctacagagtctcctttcgcccagagcaggagaattgatgactccacagtggcaggcgtggcatttgctcgctatattctggtgggctgctggaagaacttgatcgatactttatcaaccccactgactggtcgaatggcggggagctccaaagggctggccttcattctgggagctgaaggcatcaaagagcagaaccagaaggagcgggacgccatctgcatgagcctcgacgggctgcggaaagccgcacggctgagctgcgctctaggcgttgctgctaactgcgcctcagcccttgcccagatggcagctgcctcctgtgtccaagaagaaaaagaagagagggaggcccaagaacccagtgatgccatcacacaagtgaaactaaaagtggagcagaaactggagcagattgggaaggtgcagggggtgtggctgcacactgcccacgtcttgtgcatggaggccatcctcagcgtaggcctggagatgggaagccacaacccggactgctggccacacgtgttcagggtgtgtgaatacgtgggcaccctggagcacaaccacttcagcgatggtgcctcgcagccccctctgaccatcagccagccccagaaggccactggaagcgctggcctccttggggaccccgagtgtgagggctcgccccccgagcacagcccggagcaggggcgctccctgagcacggcccctgtcgtccagcccctgtccatccaggacctcgtccgggaaggcagccggggtcgggcctccgacttccgcggcgggagcctcatgagcgggagcagcgcggccaaggtggtgctcaccctctccacgcaagccgacaggctctttgaagatgctacggataagttgaacctcatggccttgggaggttttctttaccagctgaagaaagcatcgcagtctcagcttttccattctgttacagatacagttgattactctctggcaatgccaggagaagttaaatccactcaagaccgaaaaagcgccctccacctgttccgcctggggaatgccatgctgaggattgtgcggagcaaagcacggcccctgctccacgtgatgcgctgctggagccttgtggccccacacctggtggaggctgcttgccataaggaaagacatgtgtctcagaaggctgtttccttcatccatgacatactgacagaagtcctcactgactggaatgagccacctcattttcacttcaatgaagcactcttccgacctttcgagcgcattatgcagctggaattgtgtgatgaggacgtccaagaccaggttgtcacatccattggtgagctggttgaagtgtgttccacgcagatccagtcgggatggagacccttgttcagtgccctggaaacagtgcatggcgggaacaagtcagagatgaaggagtacctggttggtgactactccatgggaaaaggccaagctccagtgtttgatgtatttgaagcttttctcaatactgacaacatccaggtctttgctaatgcagccactagctacatcatgtgccttatgaagtttgtcaaaggactgggggaggtggactgtaaagagattggagactgtgccccagcacccggagccccgtccacagacctgtgcctcccggccctggattacctcaggcgctgctctcagttattggccaaaatctacaaaatgcccttgaagccaatattccttagtgggagacttgccggcttgcctcgaagacttcaggaacagtcagccagcagtcacaggagggaattgaatcagtcctgtctgattttgatgatgacaccggtctgatagaagtctggataatcctgctggagcagctgacagcggctgtgtccaattgtccacggcagcaccaaccaccaactctggatttactctttgagctgttgagagatgtgacgaaaacaccaggaccagggtttggtatctatgcagtggttcacctcctccttcctgtgatgtccgtttggctccgccggagccataaagaccattcctactgggatatggcctctgccaatttcaagcacgctattggtctgtcctgtgagctggtggtggagcacattcaaagctttctacattcagatatcaggtacgagagcatgatcaataccatgctgaaggacctctttgagttgctggtcgcctgtgtggccaagcccactgaaaccatctccagagtgggctgctcctgtattagatacgtccttgtgacagcgggccctgtgttcactgaggagatgtggaggcttgcctgctgtgccctgcaagatgcgttctctgccacactcaagccagtgaaggacctgctgggctgcttccacagcggcacggagagcttcagcggggaaggctgccaggtgcgagtggcggccccgtcctcctccccaagtgccgaggccgagtactggcgcatccgagccatggcccagcaggtgtttatgctggacacccagtgctcaccaaagacaccaaacaactttgaccacgctcagtcctgccagctcattattgagctgcctcctgatgaaaaaccaaatggacacaccaagaaaagcgtgtctttcagggaaattgtggtgagcctgctgtctcatcaggtgttactccagaacttatatgacatcttgttagaagagtttgtcaaaggcccctctcctggagaggaaaagacgatacaagtgccagaagccaagctggctggcttcctcagatacatctctatgcagaacttggcagtcatattcgacctgctgctggactcttataggactgccagggagtttgacaccagccccgggctgaagtgcctgctgaagaaagtgtctggcatcgggggcgccgccaacctctaccgccagtctgcgatgagctttaacatttatttccacgccctggtgtgtgctgttctcaccaatcaagaaaccatcacggccgagcaagtgaagaaggtcctttttgaggacgacgagagaagcacggattcttcccagcagtgttcatctgaggatgaagacatctttgaggaaaccgcccaggtcagccccccgagaggcaaggagaagagacagtggcgggcacggatgcccttgctcagcgtccagcctgtcagcaacgcagattgggtgtggctggtcaagaggctgcacaagctgtgcatggaactgtgcaacaactacatccagatgcacttggacctggagaactgtatggaggagcctcccatcttcaagggcgacccgttcttcatcctgccctccttccagtccgagtcatccaccccatccaccgggggcttctctgggaaagaaaccccttccgaggatgacagaagccagtcccgggagcacatgggcgagtccctgagcctgaaggccggtggtggggacctgctgctgccccccagccccaaagtggagaagaaggatcccagccggaagaaggagtggtgggagaatgcggggaacaaaatctacaccatggcagccgacaagaccatttcaaagttgatgaccgaatacaaaaagaggaaacagcagcacaacctgtccgcgttccccaaagaggtcaaagtggagaagaaaggagagccactgggtcccaggggccaggactccccgctgcttcagcgtccccagcacttgatggaccaagggcaaatgcggcattccttcagcgcaggccccgagctgctgcgacaggacaagaggccccgctcaggctccaccgggagctccctcagtgtctcggtgagagacgcagaagcacagatccaggcatggaccaacatggtgctaacagttctcaatcagattcagattctcccagaccagaccttcacggccctccagcccgcagtgttcccgtgcatcagtcagctgacctgtcacgtgaccgacatcagagttcgccaggctgtgagggagtggctgggcagggtgggccgtgtctatgacatcattgtgtagccgactcctgttctactctcccaccaaataacagtagtgagggttagagtcctgccaatacagctgttgcattttccccaccactagccccacttaaactactactactgtctcagagaacagtgtttcctaatgtaaaaagcctttccaaccactgatcagcattggggccatactaaggtttgtatctagatgacacaaacgatattctgattttgcacattattatagaagaatctataatccttgatatgtttctaactcttgaagtatatttcccagtgcttttgcttacagtgttgtccccaaatgggtcattttcaaggattactcatttgaaaacactatattgatccatttgatccatcatttaaaaaataaatacaattcctaaggcaaaaaaaaaaaacggaggccacaggatcccagcccggcctttgtgggactgaggtggcgctgagtgggagagcagcaggcgatgcgcgaaaggcgggacttggagataaatactgagcacccacaacaggcagccagcaccactgcagattggatactgcaatgatgataagcatggcctgcctttatggaggtgatgttattgtgtggggaggcagatggttctggatgttcctgtggataacctcaaggagcacgggacctgggacatgactgcccccagcattccttctggcggcagacagagtttgtcagttcgccaacatcctgctttcatgagaacagtttgctgtttgctcacagagcctccagtggtatactgagttggtcacgaccctcattccttcggcctccaacatctccccttttgtttttgcattaattgaataaaggtaatttcaggctgtgcagctt

SEQ ID NO: 280211 - DNA, 3527 bp, Homo sapiens
  misc_feature (3375)..(3375): n is a, c, g, or t
gggagcccacagcgtctctgtgacttggcaggacccagctccactgaatcagagtccagaaaaagatcaatttcaaaaagaaagtctcatctggatctcctcaaactcatcatggatggcatgaccgaagcatgcatcaagggtggcatcgaagcttgctatgcagccgtgtcctgtgtctgcaccttgctgggtgccctggatgagctcagccaggggaagggcttgagcgaaggtcaggtgcaactgctgcttctgcgccttgaggagctgaaggatggggctgagtggagccgagattccatggagatcaatgaggctgacttccgctggcagcggcgagtgctgtcctcagaacacacgccgtgggagtcagggaacgagaggagccttgacatcagcatcagtgtcaccacagacacaggccagaccactctcgagggagagttgggtcagactacacccgaggaccattcgggaaaccacaagaacagtctcaagtcgccagccatcccagagggtaaggagacgctgagcaaagtattggaaacagaggcggtagaccagccagatgtcgtgcagagaagccacacggtcccttaccctgacataactaacttcctgtcagtagactgcaggacaaggtcctatggatctaggtatagtgagagcaattttagcgttgatgaccaagacctttctaggacagagtttgattcctgtgatcagtactctatggcagcagaaaaggactcgggcaggtccgacgtgtcagacattgggtcggacaactgttcactagccgatgaagagcagacaccccgggactgcctaggccaccggtccctgcgaactgccgccctgtctctaaaactgctgaagaaccaggaggcggatcagcacagcgccaggctgttcatacagtccctggaaggcctcctccctcggctcctgtctctctccaatgtagaggaggtggacaccgctctgcagaactttgcctctactttctgctcaggcatgatgcactctcctggctttgacgggaatagcagcctcagcttccagatgctgatgaacgcagacagcctctacacagctgcacactgcgccctgctcctcaacctgaagctctcccacggtgactactacaggaagcggccgaccctggcgccaggcgtgatgaaggacttcatgaagcaggtgcagaccagcggcgtgctgatggtcttctctcaggcctggattgaggagctctaccatcaggtgctcgacaggaacatgcttggagaggctggctattggggcagcccagaagataacagccttcccctcatcacaatgctgaccgatattgacggcttagagagcagtgccattggtggccagctgatggcctcggctgctacagagtctcctttcgcccagagcaggagaattgatgactccacagtggcaggcgtggcatttgctcgctatattctggtgggctgctggaagaacttgatcgatactttatcaaccccactgactggtcgaatggcggggagctccaaagggctggccttcattctgggagctgaaggcatcaaagagcagaaccagaaggagcgggacgccatctgcatgagcctcgacgggctgcggaaagccgcacggctgagctgcgctctaggcgttgctgctaactgcgcctcagcccttgcccagatggcagctgcctcctgtgtccaagaagaaaaagaagagagggaggcccaagaacccagtgatgccatcacacaagtgaaactaaaagtggagcagaaactggagcagattgggaaggtgcagggggtgtggctgcacactgcccacgtcttgtgcatggaggccatcctcagcgtaggcctggagatgggaagccacaacccggactgctggccacacgtgttcagggtgtgtgaatacgtgggcaccctggagcacaaccacttcagcgatggtgcctcgcagccccctctgaccatcagccagccccagaaggccactggaagcgctggcctccttggggaccccgagtgtgagggctcgccccccgagcacagcccggagcaggggcgctccctgagcacggcccctgtcgtccagcccctgtccatccaggacctcgtccgggaaggcagccggggtcgggcctccgacttccgcggcgggagcctcatgagcgggagcagcgcggccaaggtggtgctcaccctctccacgcaagccgacaggctctttgaagatgctacggataagttgaacctcatggccttgggaggttttctttaccagctgaagaaagcatcgcagtctcagcttttccattctgttacagatacagttgattactctctggcaatgccaggagaagttaaatccactcaagaccgaaaaagcgccctccacctgttccgcctggggaatgccatgctgaggattgtgcggagcaaagcacggcccctgctccacgtgatgcgctgctggagccttgtggccccacacctggtggaggctgcttgccataaggaaagacatgtgtctcagaaggctgtttccttcatccatgacatactgacagaagtcctcactgactggaatgagccacctcattttcacttcaatgaagcactcttccgacctttcgagcgcattatgcagctggaattgtgtgatgaggacgtccaagaccaggttgtcacatccattggtgagctggttgaagtgtgttccacgcagatccagtcgggatggagacccttgttcagtgccctggaaacagtgcatggcgggaacaagtcagagatgaaggagtacctggttggtgactactccatgggaaaaggccaagctccagtgtttgatgtatttgaagcttttctcaatactgacaacatccaggtctttgctaatgcagccactagctacatcatgtgccttatgaagtttgtcaaaggactgggggaggtggactgtaaagagattggagactgtgccccagcacccggagccccgtccacagacctgtgcctcccggccctggattacctcaggcgctgctctcagttattggccaaaatctacaaaatgcccttgaagccaatattccttagtgggagacttgccggcttgcctcgaagacttcaggaacagtcagccagcagtcacaggagggaattgaatcagtcctgtctgattttgatgatgacaccggtctgatagaagtctggataatcctgctggagcagctgacagcggctgtgtccaattgtccacggcagcaccaaccaccaactctggatttactctttgagctgttgagagatgtgacgaaaacaccaggaccagggntttggtattctatgcaggggtacccgagctccgaattccgttaatccattggtccttaggcttgtttccctgtgttgaacagccgccccccccccccccccccccccccccccccccctcccccccccccccccccccccccccgcctcccc

SEQ ID NO: 280212 - DNA, 728 bp, Homo sapiens
cagggagaagaggaaactttccacttattcaccatcattcattccaactgctaaacagatccaggctcctaacagctaataaatgaaactgagaggtttgagaagacaataaacagggtctcactctgttgcccggattggagggcagtggcacaatcatggctcactgcagcctcaacctcctggccttaatcaatcctcccacttcagcctcctgagtagctgggaccacagcaaagagacaaatacacaactgtttgtatttgtgctgcttttttttcccattaccatacgtgaatggaatgaacagcttctctgaggatggatagtgtaagatgtggaattcctgcctgctatcttgtaaggagctatttgcatatgaaattttgtggacatgagattgaaaatgcgtgatttataagcaaaaggaaaaaaaaacctttaagccttcatgccctgcatttcaaatttctggctgatttataaacctttcaaagctcatgctatgaagcaattcaaaatttctatgtctatacatgtttagctaacattaactcagctagccgccccgtggcattttccgtgctagtcttcattttttccctctatattttttctcgtctcgcttttttagaaatgttattcctatttctgtcacactgtcaccttttagtctgtcttgcaagaatgtaacatcagccgccaaatgaacctaggaaagaagaaaa

SEQ ID NO: 280213 - DNA, 2054 bp, Homo sapiens
  misc_feature (326)..(326): n is a, c, g, or t
  misc_feature (487)..(487): n is a, c, g, or t
  misc_feature (566)..(566): n is a, c, g, or t
ccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctgnccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcanctttggatgtggctttggcctctttgtccaaagtgaccttggggcccccagacaagagacagggagactggagcccagncccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagatcctgagccgctatgacatcgccctggtccaggaggtcagagacagccacctgactgccgtggggaagctgctggacaacctcaatcaggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagaggtcagggagtttgccattgttcccctgcatgcggccccgggggacgcagtagccgagatcgacgctctctatgacgtctacctggatgtccaagaagaaatggggcttggaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtca

SEQ ID NO: 280214 - DNA, 2310 bp, Homo sapiens
  misc_feature (326)..(326): n is a, c, g, or t
  misc_feature (487)..(487): n is a, c, g, or t
  misc_feature (566)..(566): n is a, c, g, or t
ccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctgnccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcanctttggatgtggctttggcctctttgtccaaagtgaccttggggcccccagacaagagacagggagactggagcccagncccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagatcctgagccgctatgacatcgccctggtccaggaggtcagagacagccacctgactgccgtggggaagctgctggacaacctcaatcaggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagaggtcagggagtttgccattgttcccctgcatgcggccccgggggacgcagtagccgagatcgacgctctctatgacgtctacctggatgtccaagaagaaatggggcttggaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggtatgtgtcctcccttgcacagccacatgaggatgggacacaggagctcaggttggacaccagctcttcctgtgtcatcccgataccagtatcctgaggagagagacgcactaagtgccaagcccccagcacctggggagccgggtgagtgcaccagcagtcccagggactcaagtggtgtcaatgacattggccagacagggcccagccaggtagcaccagatgctcatcagaaaagactaattctaggggccgggagtgatggttcatgcctgtaatcccagcactatgggaggccaaggcaggcggatcacttgaggccaggagttcaagaccagcctggccaacatggtaaaaccccatctctactaaaaaagaaattagccaggcatgatggcgagcacctgtggttccagctactcggaggctgaggcaggaaaattgct

SEQ ID NO: 280215 - DNA, 1984 bp, Homo sapiens
  misc_feature (326)..(326): n is a, c, g, or t
  misc_feature (487)..(487): n is a, c, g, or t
  misc_feature (566)..(566): n is a, c, g, or t
ccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctgnccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcanctttggatgtggctttggcctctttgtccaaagtgaccttggggcccccagacaagagacagggagactggagcccagncccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagatcctgagccgctatgacatcgccctggtccaggaggtcagagacagccacctgactgccgtggggaagctgctggacaacctcaatcaggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagaggtcagggagtttgccattgttcccctgcatgcggccccgggggacgcagtagccgagatcgacgctctctatgacgtctacctggatgtccaagaagaaatggggcttggaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggctgcctatggcctgagtgaccaactggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtca

SEQ ID NO: 280216 - DNA, 1484 bp, Homo sapiens
  misc_feature (326)..(326): n is a, c, g, or t
  misc_feature (487)..(487): n is a, c, g, or t
  misc_feature (566)..(566): n is a, c, g, or t
ccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctgnccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcanctttggatgtggctttggcctctttgtccaaagtgaccttggggcccccagacaagagacagggagactggagcccagncccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacaggccacagcagcgtttcctggtagacgtcatgttaggcgacttcaatcggtctttcgccacagggatcctctagaa

SEQ ID NO: 280217 - DNA, 805 bp, Homo sapiens
ttgatccactacagggaacagaataacaagagccacgatttttaggttttttcggaaaagcacatctggggataagaggagaggcagacacctaggctgtcatgtggtttccacattgaggggcacagaccagggtgtgcagttttgggcacccacagacctgcactggcaggtcccagggctcttagtttagttcctgcgggtgctgagccaggcccatgtgtgaaaggggaacctactttctcttcccaacacccatcaggatcgtggttgcagggatgctgctccgaggcgccgttgttcccgactcggctcttccctttaacttccaggctgcctatggcctgagtgaccaactggtatgtgtcctcccttgcacagccacatgaggatgggacacaggagctcaggttggacaccagctcttcctgtgtcatcccgataccagtatcctgaggagagagacgcactaagtgccaagcccccagcacctggggagccgggtgagtgcaccagcagtcccagggactcaagtggtgtcaatgacattggccagacagggcccagccaggtagcaccagatgctcatcagaaaagactaattctaggggccgggagtgatggttcatgcctgtaatcccagcactatgggaggccaaggcaggcggatcacttgaggccaggagttcaagaccagcctggccaacatggtaaaaccccatctctactaaaaaagaaattagccaggcatgatggcgagcacctgtggttccagctactcggaggctgaggcaggaaaattgct

SEQ ID NO: 280218 - DNA, 1965 bp, Homo sapiens
  misc_feature (326)..(326): n is a, c, g, or t
  misc_feature (487)..(487): n is a, c, g, or t
  misc_feature (566)..(566): n is a, c, g, or t
ccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctgnccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcanctttggatgtggctttggcctctttgtccaaagtgaccttggggcccccagacaagagacagggagactggagcccagncccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagaggtcagggagtttgccattgttcccctgcatgcggccccgggggacgcagtagccgagatcgacgctctctatgacgtctacctggatgtccaagaagaaatggggcttggaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtca

SEQ ID NO: 280219 - DNA, 1865 bp, Homo sapiens
  misc_feature (326)..(326): n is a, c, g, or t
  misc_feature (487)..(487): n is a, c, g, or t
  misc_feature (566)..(566): n is a, c, g, or t
ccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctgnccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcanctttggatgtggctttggcctctttgtccaaagtgaccttggggcccccagacaagagacagggagactggagcccagncccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagatcctgagccgctatgacatcgccctggtccaggaggtcagagacagccacctgactgccgtggggaagctgctggacaacctcaatcaggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagaggtcagggagtttgccattgttcccctgcatgcggccccgggggacgcagtagccgagatcgacgctctctatgacgtctacctggatgtccaagaagaaatggggcttggaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggtgagcagggcctcgcgcttagggcagactgagggcacctccaagggcagccgtgactcataggtcgggcttcagaagcctcaaagcctttgaacact

SEQ ID NO: 280220 - DNA, 272 bp, Homo sapiens
aggtcagggagtttgccattgttcccctgcatgcggccccgggggacgcagtagccgagatcgacgctctctatgacgtctacctggatgtccaagaagaaatggggcttggaggtgaggccctcccaggggcagtgggcaccagcggcctccgcatgtcccagggccacaggcagcgtttcctggtaggacgtcatgttgatgggcgacttcaatgcgggctgcagctatgtgagaccctcccagtggtcatccatccgcctgtggacaag

SEQ ID NO: 280221 - DNA, 602 bp, Homo sapiens
ccgtggggtgcgtcgatcctgtagctcagagggagaagctacttagaacttcgtgaagcacagaggatctggactgcccttttggccccgtgcaattttattagaaatcattatccctttcgcaattaaacataaccaccaaaccaagaccggcgaagtcactccaggattttttcccaacaagggatcgcctccgctcgaggcagccaccccctcgggccgcagcgccttgggagttttattggctttgagctttcccccaggttggagattctgccaagcggctccggtggctctgctggggtttgcaatcccttaattgcagcgtgtaaaataaaagttgtaccctgaagaggttacttgacagctccaggggttaaacaatttttctcctgtttgtgtgaagctagggccaactgacagttcaaattggtgttcaggctaaggtttcctgggtgcaacgtggacacgaatacagaactcctatggaactgcacacccgcttctgaagttgagcctaaaaacagacgtgtgtgtgcctgcaagtctagataccgtctcgtgcgtgcatcaaaataaatcaccgggaaccgaaatttagc

SEQ ID NO: 280222 - DNA, 1365 bp, Homo sapiens
ggccctcaatctcgatgaagataacacgaggagtgcacaggcaagtgcccagttgccagcaattgcttcaaaagcccatgttcttcttttcccccattcttaggcacagccaaaattggtcagaaaggggagtaaagtgggacacgagcttcaaagtagggaaaccaaagaagggagcatccacgtcctctctctccagcttctcccccgcgttcttcgggcgaatccgagggacgggcgctgcgctggggaaagtttgtcccacccgcgtttcgcagctggttgcaaggagaggaggaggagagggagggtcaagctcggagcctgtgaccgcacggatgatcgagccggcgtcgcgcttacctcgcagtcctcgtacttgatattatccgtcaatttccaaagcattttcatggatcggcgtgaacggatatgcccctctcggtctcgcacccaagtggagctactctctggctctttaccaacagcctaatcgcctcattagcatatcaacaatagtccaattgctcgccagtaccacaatctgccgccggccgctccgacacaggtataaaggcctctctacgccgcgaacttgcttctagagcgcactccagcctgcgaactgataaaaccttcctcgagctccgccgcgaggccctgccccaacaccccctctcttaccccaattccgccacattccccttcctttctttctccgcttccttttctccagagatgccttctgcaaagcccggcactgctcaaggtccaagcgccacgcctggggcccagcttctagcacttctcccttaaccctgctaccacgatccgagctgcccttttggccccgtgcaattttattagaaatcattatccctttcgcaattaaacataaccaccaaaccaagaccggcgaagtcactccaggattttttcccaacaagggatcgcctccgctcgaggcagccaccccctcgggccgcagcgccttgggagttttattggctttgagctttcccccaggttggagattctgccaagcggctccggtggctctgctggggtttgcaatcccttaattgcagcgtgtaaaataaaagttgtaccctgaagaggttacttgacagctccaggggttaaacaatttttctcctgtttgtgtgaagctagggccaactgacagttcaaattggtgttcaggctaaggtttcctgggtgcaacgtggacacgaatacagaactcctatggaactgcacacccgcttctgaagttgagcctaaaaacagacgtgtgtgtgcctgcaagtctagataccgtctcgtgcgtgcatcaaaataaatcaccgggaaccgaaatttagc

SEQ ID NO: 280223 - DNA, 1313 bp, Homo sapiens
ggcagagagggagaccgaaggagagagcgcagagagggagaatgtgtctgcgcacagccaaaattggtcagaaaggggagtaaagtgggacacgagcttcaaagtagggaaaccaaagaagggagcatccacgtcctctctctccagcttctcccccgcgttcttcgggcgaatccgagggacgggcgctgcgctggggaaagtttgtcccacccgcgtttcgcagctggttgcaaggagaggaggaggagagggagggtcaagctcggagcctgtgaccgcacggatgatcgagccggcgtcgcgcttacctcgcagtcctcgtacttgatattatccgtcaatttccaaagcattttcatggatcggcgtgaacggatatgcccctctcggtctcgcacccaagtggagctactctctggctctttaccaacagcctaatcgcctcattagcatatcaacaatagtccaattgctcgccagtaccacaatctgccgccggccgctccgacacaggtataaaggcctctctacgccgcgaacttgcttctagagcgcactccagcctgcgaactgataaaaccttcctcgagctccgccgcgaggccctgccccaacaccccctctcttaccccaattccgccacattccccttcctttctttctccgcttccttttctccagagatgccttctgcaaagcccggcactgctcaaggtccaagcgccacgcctggggcccagcttctagcacttctcccttaaccctgctaccacgatccgagctgcccttttggccccgtgcaattttattagaaatcattatccctttcgcaattaaacataaccaccaaaccaagaccggcgaagtcactccaggattttttcccaacaagggatcgcctccgctcgaggcagccaccccctcgggccgcagcgccttgggagttttattggctttgagctttcccccaggttggagattctgccaagcggctccggtggctctgctggggtttgcaatcccttaattgcagcgtgtaaaataaaagttgtaccctgaagaggttacttgacagctccaggggttaaacaatttttctcctgtttgtgtgaagctagggccaactgacagttcaaattggtgttcaggctaaggtttcctgggtgcaacgtggacacgaatacagaactcctatggaactgcacacccgcttctgaagttgagcctaaaaacagacgtgtgtgtgcctgcaagtctagataccgtctcgtgcgtgcatcaaaataaatcaccgggaaccgaaatttagc

SEQ ID NO: 280224 - DNA, 908 bp, Homo sapiens
ggccctcaatctcgatgaagataacacgaggagtgcacaggcaagtgcccagttgccagcaattgcttcaaaagcccatgttcttcttttcccccattcttaggcacagccaaaattggtcagaaaggggagtaaagtgggacacgagcttcaaagtagggaaaccaaagaagggagcatccacgtcctctctctccagcttctcccccgcgttcttcgggcgaatccgagggacgggcgctgcgctggggaaagtttgtcccacccgcgtttcgcagctggttgcaaggagaggaggaggagagggagggtcaagctcggagcctgtgaccgcacggatgatcgagccggcgtcgcgcttacctcgcagtcctcgtacttgatattatccgtcaatttccaaagcattttcatggatcggcgtgaacggatatgcccctctcggtctcgcacccaagtggagctactctctggctctttaccaacagcctaatcgcctcattagcatatcaacaatagtccaattgctcgccagtaccacaatctgccgccggccgctccgacacaggtataaaggcctctctacgccgcgaacttgcttctagagcgcactccagcctgcgaactgataaaaccttcctcgagctccgccgcgaggccctgccccaacaccccctctcttaccccaattccgccacattccccttcctttctttctccgcttccttttctccagagatgccttctgcaaagcccggcactgctcaaggtccaagcgccacgcctggggcccagcttctagcacttctcccttaaccctgctaccacgatccgagctgcccttttggccccgtgcaattttattagaaatcattatccctttcgcaattaaacataaccaccaaacc

SEQ ID NO: 280225 - DNA, 1145 bp, Homo sapiens
ggcagagagggagaccgaaggagagagcgcagagagggagaatgtgtctgcgcacagccaaaattggtcagaaaggggagtaaagtgggacacgagcttcaaagtagggaaaccaaagaagggagcatccacgtcctctctctccagcttctcccccgcgttcttcgggcgaatccgagggacgggcgctgcgctggggaaagtttgtcccacccgcgtttcgcagctggttgcaaggagaggaggaggagagggagggtcaagctcggagcctgtgaccgcacggatgatcgagccggcgtcgcgcttacctcgcagtcctcgtacttgatattatccgtcaatttccaaagcattttcatggatcggcgtgaacggatatgcccctctcggtctcgcacccaagtggagctactctctggctctttaccaacagcctaatcgcctcattagcatatcaacaatagtccaattgctcgccagtaccacaatctgccgccggccgctccgacacagagatgccttctgcaaagcccggcactgctcaaggtccaagcgccacgcctggggcccagcttctagcacttctcccttaaccctgctaccacgatccgagctgcccttttggccccgtgcaattttattagaaatcattatccctttcgcaattaaacataaccaccaaaccaagaccggcgaagtcactccaggattttttcccaacaagggatcgcctccgctcgaggcagccaccccctcgggccgcagcgccttgggagttttattggctttgagctttcccccaggttggagattctgccaagcggctccggtggctctgctggggtttgcaatcccttaattgcagcgtgtaaaataaaagttgtaccctgaagaggttacttgacagctccaggggttaaacaatttttctcctgtttgtgtgaagctagggccaactgacagttcaaattggtgttcaggctaaggtttcctgggtgcaacgtggacacgaatacagaactcctatggaactgcacacccgcttctgaagttgagcctaaaaacagacgtgtgtgtgcctgcaagtctagataccgtctcgtgcgtgcatcaaaataaatcaccgggaaccgaaatttagc

SEQ ID NO: 280226 - DNA, 321 bp, Homo sapiens
gatcacgaggtcaggagttcgagaccatcctggccagcatgtcatgttgtcataggaacaactggagaagaataaagtggacacgaaaagggagagtattcttccaacgataatactcacatcgcagaacgcgaaaatcttctgtcaggaggggcgatcctcagagtcactgggctacacaccatcctggagttgcgaggggacagcacagccttcttgtgataaccattccagcacactgtgggaagtacccccagacaggaatactgggcctgatggatcggatagcgtcttcgaggtgttattacaaaccgatctggt

SEQ ID NO: 280227 - DNA, 687 bp, Homo sapiens
ttttctacgatagatcacagttttttattcttaatgtcacaagcaggagaaaaatctcacattcatactaaaaattccaactagactcaacaggaatgaagtctctatttgtaatggaaagtcccagcctcccgctgccgtccagtgtgtgtactgtacacatccacactcactctcactcagggttcccggaccggctgtcctgcctgcggaactgaggtaaacaagctcaggtactgacactaggagggtctaccttacataaggtacaggtagaagcttgattgctaggcccaggcccacccagaccctccaatcctaacaggtatttaggcttgaggttcactccctcctcagctgcacacgcagccaggtataacactcgccctcagtcacaacggggagggggcaccggttacatctacatcacattatttataaaataagaattacatttcatataacatggccagaaggagctctagtcccccaggaaagctgccgggacagcatttgagcctcttctttgcacaggcataacttaactatacagctaattggggggggccccccctgaaaaataatccccccaaataagcagcatgtcatgtccttagaatatgttacactagaaaggtagaaaaattcaggctaaggaggcaatttagagtcaagttatcacgaatt

SEQ ID NO: 280228 - DNA, 1525 bp, Homo sapiens
gcggccgccggcaactcgtccgtcttgataaccatggtggcgggagcgggcgtccgcctcggctgtccgcgccgcccgccgcgccactaacccaagtgccctgcgcgccgcggctgctgagggaaggacggagtcaccggcccacgtggtgcgcgccgtggcctttgaccccgccgccgtttccctgccccaccctcgcgcccggcccagcccacggcggcccgcgagggacaaaacgcgccgcgcctggttccccgcccacggacgcggtgactttccagaacgtcttaaaggcaacgcactctgactcaaggcccagggaggctgggcgccctcgcggggcggggcctcggggagactccctgctgctcgctgcccgtcgggcgggcactgtgaccttgggtggagactggtctggttctgccatggctaatcctcccctctccaaggatcccctgttttctcttgcagatttgctaaatgaccgcgcagtctgtcatctgcggtgttcgcgtgaccctcagcgccctccccacccggcaggccctttcccgccgaatgggtgcggctggattattgagggagtggagggtcgcttagggcacgggcacgagaggcgagggcgagacgtggctaatggggatcaagagtcagaatggacccgccaaactttgccccgagccagaacgggctccctacccgcgtcctcgacccatgggtcctcacctccaggctggtgtcctcattttacagtggaggaggccgagaccaaggtcacacagagagcaaggggtagagccgggtctgactccatccacagccaggacgctttaactcgtatttttcacttggcaggggcttggcggggacggaacggtgaggtcagagaatgctgcagaggggacattgggaccaggtcttgcagtgagttgaagtgctccaggcagagagcgccggtgggtctttcctggccaggccgcagggggcctttgggaagcacccgaggcctataaccttcggagcgtttgtcaagctctaatgagaactggaaagcttcagcttcccgaggtgggctgggagggccctaggtagggcctcgcacaaattgcgaaggaaagccgaccttgttctggagagcacgtggtgaggaaagccagcgacttgatgtgagcatttaaacgggaggaaggaagatgagaactggtaagattcttctcggccgggcggtgcagcggctcacgcctgtaatcctagcactttgggaggccgaagccaggcggatgacttgagttcaggattcggaagtttgagaccaacctgggcaacatttcaaaacccccgtctctacaaaaaatattgtttaaaaaaagccaggtgtagtggcacgcgcctgtagtcccagctacttgggagctgagctgggagtatcactcaggacggctcagattgagcccaggagttccaagctgcagtgagctatgatcgcaccactgcactcctgcctgggtgacacagacaccgtctc

SEQ ID NO: 280229 - DNA, 1443 bp, Homo sapiens
gcggccgccggcaactcgtccgtcttgataaccatggtggcgggagcgggcgtccgcctcggctgtccgcgccgcccgccgcgccactaacccaagtgccctgcgcgccgcggctgctgagggaaggacggagtcaccggcccacgtggtgcgcgccgtggcctttgaccccgccgccgtttccctgccccaccctcgcgcccggcccagcccacggcggcccgcgagggacaaaacgcgccgcgcctggttccccgcccacggacgcggtgactttccagaacgtcttaaaggcaacgcactctgactcaaggcccagggaggctgggcgccctcgcggggcggggcctcggggagactccctgctgctcgctgcccgtcgggcgggcactgtgaccttgggtggagactggtctggttctgccatggctaatcctcccctctccaaggatcccctgttttctcttgcagatttgctaaatgaccgcgcagtctgtcatctgcggtgttcgcgtgaccctcagcgccctccccacccggcaggccctttcccgccgaatgggtgcggctggattattgagggagtggagggtcgcttagggcacgggcacgagaggcgagggcgagacgtggctaatggggatcaagagtcagaatggacccgccaaactttgccccgagccagaacgggctccctacccgcgtcctcgacccatgggtcctcacctccaggctggtgtcctcattttacagtggaggaggccgagaccaaggggcttggcggggacggaacggtgaggtcagagaatgctgcagaggggacattgggaccaggtcttgcagtgagttgaagtgctccaggcagagagcgccggtgggtctttcctggccaggccgcagggggcctttgggaagcacccgaggcctataaccttcggagcgtttgtcaagctctaatgagaactggaaagcttcagcttcccgaggtgggctgggagggccctaggtagggcctcgcacaaattgcgaaggaaagccgaccttgttctggagagcacgtggtgaggaaagccagcgacttgatgtgagcatttaaacgggaggaaggaagatgagaactggtaagattcttctcggccgggcggtgcagcggctcacgcctgtaatcctagcactttgggaggccgaagccaggcggatgacttgagttcaggattcggaagtttgagaccaacctgggcaacatttcaaaacccccgtctctacaaaaaatattgtttaaaaaaagccaggtgtagtggcacgcgcctgtagtcccagctacttgggagctgagctgggagtatcactcaggacggctcagattgagcccaggagttccaagctgcagtgagctatgatcgcaccactgcactcctgcctgggtgacacagacaccgtctc

SEQ ID NO: 280230 - DNA, 770 bp, Homo sapiens
tcttactttatcagcaggtctcttttcagcttccttctttaccttttcagttgtgaggaccttgccattattattaccagaaggaagactggatgatattttgggctcttgcttaatggaaatgttttttgtgcttgaaattttgggtggctccacatcctaaaagatgaaaaaaggcattatctagttccttccccctgaaacaactagcagtatcagttttctgtgtatccatatcgatggtaacgttttaaatccagtataccccatcatccccagatgaaaccgtctagctgcaggaaagcaagctcaaggttcccactgattctacattatgaatgtaagttccatgaaggcaggcagtggattggtcttgcctactgttgtaacccctgtctggcagagttcctggaaaacagcaaataactacatggtcttgctctgtcacccaggttggagtgcactgagatcatggctcactgcagcctcgaactcctgggctcaagtgatcctcctgcctcagcctcccaagcagctaggactacaggcatgcaccaccgtaaccatgcccagatccatttttcaccctacctggcaatctcaaaagaagtccaaagttgatcatatgcacgtgccccagatgaaggaaacagaaactgttcacatagagtgcagtattatcgttgccatttcataatggctctaaaaaactttgttcttcatgacttcgcaagctcttgcaaccccttccaataaacattgatcgaaag

SEQ ID NO: 280231 - DNA, 456 bp, Homo sapiens
aatcaccaaaaagttattacaaataaaagtaaatttccttcttattcctgacaggcattatctagttccttccccctgaaacaactagcagtatcagttttctgtgtatccatatcgatggtaacgttttaaatccaggttggagtgcactgagatcatggctcactgcagcctcgaactcctgggctcaagtgatcctcctgcctcagcctcccaagcagctaggactacaggcatgcaccaccgtaaccatgcccagatccatttttcaccctacctggcaatctcaaaagaagtccaaagttgatcatatgcacgtgccccagatgaaggaaacagaaactgttcacatagagtgcagtattatcgttgccatttcataatggctctaaaaaactttgttcttcatgacttcgcaagctcttgcaaccccttccaataaacattgatcgaaag

SEQ ID NO: 280232 - DNA, 746 bp, Homo sapiens
tcttactttatcagcaggtctcttttcagcttccttctttaccttttcagttgtgaggaccttgccattattattaccagaaggaagactggatgatattttgggctcttgcttaatggaaatgttttttgtgcttgaaattttgggtggctccacatcctaaaagatgaaaaaaggcattatctagttccttccccctgaaacaactagcagtatcagttttctgtgtatccatatcgatggtaacgttttaaatccagtataccccatcatccccagatgaaaccgtctagctgcaggaaagcaagctcaaggttcccactgattctacattatgaatgtaagttccatgaaggcaggcagtggattggtcttgcctactgttgtaacccctgtctggcagagttcctggaaaacagcaaataactgttggagtgcactgagatcatggctcactgcagcctcgaactcctgggctcaagtgatcctcctgcctcagcctcccaagcagctaggactacaggcatgcaccaccgtaaccatgcccagatccatttttcaccctacctggcaatctcaaaagaagtccaaagttgatcatatgcacgtgccccagatgaaggaaacagaaactgttcacatagagtgcagtattatcgttgccatttcataatggctctaaaaaactttgttcttcatgacttcgcaagctcttgcaaccccttccaataaacattgatcgaaag

SEQ ID NO: 280233 - DNA, 315 bp, Homo sapiens
ctatgttaaagttttacttttctgttttttaatttgtaatagataatactgtacacatgatataaaatttaaaatcaccaaaaagttattacaaataaaagtaaatttccttcttattcctgacaggcattatctagttccttccccctgaaacaactagcagtatcagttttctgtgtatccatatcgatggtaacgttttaaatccaggtaggcctctccctgccacagaactccttcctaactgtgttttaaaagatacacttcgcagtttcagtacatagaacttgatgggtttacgtcaagtttactctg

SEQ ID NO: 280234 - DNA, 2340 bp, Homo sapiens
  misc_feature (172)..(172): n is a, c, g, or t
  misc_feature (1948)..(1948): n is a, c, g, or t
  misc_feature (1954)..(1954): n is a, c, g, or t
  misc_feature (1956)..(1956): n is a, c, g, or t
  misc_feature (2084)..(2084): n is a, c, g, or t
  misc_feature (2109)..(2109): n is a, c, g, or t
  misc_feature (2313)..(2313): n is a, c, g, or t
  misc_feature (2325)..(2325): n is a, c, g, or t
aaagaaacatggtctcactctgttgcccaggctggagtacagtggcacaattatagctcactgcagcctcaaactcctgggctcaagcaatcctcctgtctcagcctcctgagtagctggaactacaggtgtgtgctaccactcctggctaagaataccctttgtttggctngtcttaccttatagaaagagtaacagtaatagtacagtgctactccattatcaataggatatgtaactgtaggtttgtactacactagttttgcacaatcacctgtataatcactggcacatggctctaagactattgttgcgtcaaggatgaggtcaatcactaacactgtaaacagcaagtgaaacttaagtaacagaaaagaaagaactgatgcgaatgagaattgctgaactctgctatatgataattctctagctctccactttagaaaagccagaatataaaccctcctgggatatgaagatgacatttccattttgatgatcatctgaaattctttaatgcatcaggattatagtaaatatatcatccttgccaacattccccagataaatgggattttagattagatgagtgatagaaatcttctaaccttgagtttaggaaattatttaatgatacaaaaatacaactatttcttccctaaagattgtatgagttaggaaactcttataaaccatttcctttatgttttagtctatctgaatttctctttacttctgctggaaatgccttgtcaggtacaaaattgcaaagtaattgctcgacttcaatatgactacgtttacaagaatgagaaaatcacatagacctttggggcttatttcaacaaatgaaacgtcaggctgaggccaaacataactcctctggggtttatttgtaccaagctgacaaataaagccaggcagagtttgtttggactcactctgacatttcctctattgaaataagtatattatatattcattaaaagtcattatttcaggaatatctaatattttgagaaatactgtctatatactattaaatgaaaacatgcaaaacctctctatatatagcatatcaattttttaaaaaaaggaaactattaagaaaaaataataaaatgttactaaaagctatttctggtataattataagtgattttttatttttgttacttttaatttcttgttctcattttataatcaagttgaaggagtaataataagtagcagaatacagaaaccaattttattgataaaaaatttcaccaaagacaaattcttccccaattagggtatgaaagagcttaactgcctattacctgcatcaataaagagaacttttaccctgttatttcaagagaaaaagcaatactaaacatattttttcttaaggaaacattttatttcctgaagtagtttggtgaattaaaatttttttaaaagacatttttatcaaataagtatatgaattacatttatccaagtttaggtaaatctgagatgatatatgaaatcaaataataactaagccaaaagatattcaagaactccctcttttttctgatgtcttggaggattgaattaaataataataataataaataaaaagaacttccttttttaaagtcacgggtccagtaacaaagacccactattctcatttccaaaaagtaaaaatacaataaagttaaagcgataatgggatagaagagaataaacagatcatgtctcagaaccacctgaatctttgaaccatgagacctctgagtccctccaggacatgaagcactttcaggacaagtattctctatcaactgagaatatgtacatgtcctctatagcaattataactcaagtatcttaggagaattttcctaaaatgagtacatttttaatagtgctccagatggtcgtcacagcatgttaatgtaaaccaccataaaanctgttncnaatactaacatacatgcacatatacacacgcacacacacacacacacacacacacacacacacacacacacatgcccgcgcacacagtgttctggttgctgaggctctagttaagcatttttatgcantaaattttaactcattatttgaccntcaacgttatgttaaattaaaacagaaaatcttgaaatatttttaacagtacttgccttttttgcagattcagaaaagagaactccgttgtttccaacgatacctactgggtacccaaatattcgagcaaatcctcaaaagaaagttcaaagaagatttatgtcttgtgcttttccaagggcttcaattcacaagaaagaggcntatttacacatnctttaatatcagatc

SEQ ID NO: 280235 - DNA, 520 bp, Homo sapiens
aataaggaaaccacatctggcttagaaatggaaagacctgcttgcagaaaatgaaataaattcaagatcagtcattgaatcctaagaggggccacaaaggaaatgtcagatggagatgaagaagaatacttacccagtgagaccagatggccatagttctccaacattacacatctgtacaaatctctttgagcaggctgaagccatttccactcctcctgggagaagtctatggccacatctctgaatgtcactgacccctgaaatgacggacagatatttgcatgaccagcacgcatgcccccaaactccctcatcaaggaataaaatgagtctcactgtggaggttaggcaatgtgtctaagtagtaacagtgagagttttcagaattctgagtaattatataatgaagagcctagctcttgtgttttgttgtataactggagaaaaggagaaaaacataaattatctgtcctgagataatttacaattttattcaaaataaaggattatacacatg

SEQ ID NO: 280236 - DNA, 1084 bp, Homo sapiens
agcgaatgccagtgaatcccagggcgccctctcccgcgcgttggttctctagccctccttccctgggaggggtgggattgggagtgttctgttttcattactgcaccccttcccctaaagacaacgggactgccctcctccacagcgccttacctcaaacaggggaccgatcttgttcttctccaggttggacacctaatttgcacatcaggactgccatggaccatggtgcaatgaaggtgaagactggagcactcatcacccacgggtctcactttgttgcccaggctggagtatagtgccctgatcacagcttgctgcaacctcaagctcccatgctcaagcaagcttcctgcctcaacttcccaagtagctgagaccacaggcatgctccatgacacctgaactcctgaactcaagcgatcctcctgcctcagccttccaaagtgctgggattacaggcatgagcccctgaaccctgcctaccctctgtttctatgtggtatttgtctttctaagcctggcctatttcgtgtaacataatttcctccagatttatccatattgtctcaaatgaccagatttctttcttttttaaggctgaatagtattccattgtacatatatactacattttatttatccattcatctgttgatggacacttaggttgattccatatcttggctattgtgaataagctgcaatgaacataggagtgcagatactgctttgacatattcatttcattttctttggatatgtatccagaagtggaattgggctggaatataggcagttctatttttaatattttgaggaaactccatattactttccataatagctgtgctaatttacattcccaccgccaatgtataagggcttccttttctccacatcctctccaacactggttatctcttgtctttttgatatgttttctcttctctgtaaagctattggttgtagcattttactttttccaaatttttttaatcaaacttttgaaatgtatagctgaaatgaaagaattttagcatgaatgctaatatacactcagcacctatattcttgctttttc

SEQ ID NO: 280237 - DNA, 560 bp, Homo sapiens
atagtgcctcttatgcttatgctgcaattaagcaacttgtggaagaggcttatgtggtgacattaggaaaaaaggttggacacctaatttgcacatcaggactgccatggaccatggtgcaatgaaggtgaagactggagcactcatcacccacgggtctcactttgttgcccaggctggagtatagtgccctgatcacagcttgctgcaacctcaagctcccatgctcaagcaagcttcctgcctcaacttcccaagtagctgagaccacaggcatgctccatgacacctgaactcctgaactcaagcgatcctcctgcctcagcactttgggaggctgaggcgggcagatcacgaggtcaggagatggaaaacatcctggttaacacggtgaaaccccatctctactaaaaaaatacaaaaaattagccgggtatggtggcgggcgcctgtagtcccagctactcgggaggctgaggcaggagaatggcgtgaacccgggaggcggagcttgcagtgagccaagatcgcaacactgcactccagcctgagcaacagag

SEQ ID NO: 280238 - DNA, 552 bp, Homo sapiens
ggtttttcccagaacacccaggactctggccaggggctggaaggtgctccaggctcaatgctgggcaatactcatggattaattggtgctggctgggcctgccagcctagtcgtggccccagggtccccactaaagggctccttctccagcgcccactctgttggcaaggtcttcactaccatcacctgcctggactccatccaagcatcagggttgctgcagtcgctcctgaagagacccggctctgcttgaaagttcttccctcagcgcctgctggagccctccctgccggagttgccagaatccacacggaatccacagatctgccctgatgatcatgaaggaatgcgaaagagcctggtaaaacgatatggacttgtgcaaatgcaaagcaatggtgaagtcatcacgaaccgcacagactggacagaactcctatctggctgcaatggcttgggttcagtcagcccaggggccagagaattggctacaaagagctctggagtgcccctccctccaaataaagtattctaagcgtgcactgatcaaca

SEQ ID NO: 280239 - DNA, 512 bp, Homo sapiens
aagagatcagaattcagcttccccagggacagcaaggccaagaaggtgtccagatcctggcctctctccagatcttggactctctcaaggccaagactctctctcttaagatctctatctcaaggccaagatctctctccagatattggcctctctcaaggtacttccaagatctcagagggccattcactgtggatctaatatgaagacagagaaaccagccttccagaggagcggacacatttccttagtcccaggatacactttgtgtggaatccacagatctgccctgatgatcatgaaggaatgcgaaagagcctggtaaaacgatatggacttgtgcaaatgcaaagcaatggtgaagtcatcacgaaccgcacagactggacagaactcctatctggctgcaatggcttgggttcagtcagcccaggggccagagaattggctacaaagagctctggagtgcccctccctccaaataaagtattctaagcgtgcactgatcaaca

SEQ ID NO: 280240 - DNA, 1072 bp, Homo sapiens
gaaaacatcttggggtctccacattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatttacgccgggggcgggggcaaagagaaaaaataaactttaacctt

SEQ ID NO: 280241 - DNA, 1106 bp, Homo sapiens
gaaaacatcttggggtctccacattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttacctttaaaaaatt

SEQ ID NO: 280242 - DNA, 2387 bp, Homo sapiens
gaggagacgcgctttgtgctgggcgccggccgcgccagccacggcctgcggcgcccgcggcaccatgatctccaccaaggagaagaacaagatcccgaaggacagcatgacgcttctgccctgcttctacttcgtggagctgcccatagtggcttcttccatcgtatccttgtacttcctggagctgaccgacctcttcaagccggccaaggtgggcttccagtgctatgaccgcactctctccatgccctacgtggagaccaacgaggagctcatcccgctgctgatgctgctcagcttggccttcgcggcccctgccgcctcgatcatggtggccgagggcatgttgtactgtctgcagtcccggctgtggggccgtgccggggggcccgccggggcggagggcagcatcaacgccggcggctgcaacttcaactccttcctgcggcgtacggtgcggtttgtgggtgtccacgtgttcggcctgtgtgccacagccctggtgacggacgtgatccagctggccacgggttaccacactcccttcttcctcaccgtctgcaagcccaactacactctcctgggcacgtcctgcgaggtcaacccctacatcacgcaggacatctgctccggccacgacatccacgccatcctgtctgcacggaagaccttcccgtcccagcacgccacgctgtcagccttcgccgcggtctatgtgtcggtgagtccggcacctcactgcccttcccaggccctcttgctgacccgtggggagccctccctgaccccaacccccatgccccagatgtacttcaactcggtcatctcggacaccaccaagctgctgaagcccatcctggtcttcgcctttgccatcgccgcgggcgtatgcgggctcacgcagatcacgcagtaccgcagccaccctgtggacgtgtatgccggcttcctcatcggggcgggcatcgctgcctacctggcctgccacgcggtgggcaacttccaggccccacctgcagagaagcccgcggccccggcccccgccaaggacgcgctgcgggccctgacgcagcggggccacgactcggtttatcagcagaataagtcggtgagcaccgacgagctggggcccccagggcggctggagggcgcgccccggcccgtggcccgcgagaagacctcgctgggcagcctgaagcgcgccagcgtggacgtggacctgctggccccgcgcagccccatggccaaggagaacatggtgaccttcagccacacgctgcccagggccagcgcgccctcgctggacgaccccgcgcgccgccacatgaccatccacgtgccgctggacgcctcgcgctccaagcagctcatcagcgagtggaagcagaagagcctggagggccgcggcctggggctgcccgacgacgccagccccgggcacctgcgcgcgcccgccgaacccatggcggaggaggaggaagaggaggaggacgaagaggaagaggaggaggaggaagaggaggaggacgagggcccggccccgccctcgctctaccccaccgtgcaggcgcggccggggctggggcctcgggtcatcctcccaccgcgcgcggggccgccgccgctggtgcacatcccggaggagggcgcgcagacgggggccggcctgtcccccaaaagcggcgccggggtgcgcgccaagtggctcatgatggccgagaagagcggggcggcagtggccaaccctccgcggctgctgcaggtcatcgccatgtccaaggctccgggcgcgccgggccccaaggcggccgagacggcgtcgtcgtccagcgccagctccgactcctcgcagtaccggtcgccgtcggaccgcgactccgccagcatcgtgaccatcgacgcgcacgcgccgcaccaccccgtggtgcacctgtcggccggcggcgcgccctgggagtggaaggcggcgggcggcggggccaaggcggaggccgacggcggctacgagctgggggacctggcgcgcggcttccgcggcggggccaagcccccgggcgtgtcccccggctcgtcggtcagcgacgtggaccaggaggagccgcggttcggggccgtggccaccgtcaacctggccacgggcgaggggctgcccccgctgggcgcggccgatggggcgctgggcccgggcagccgggagtccacgctgcggcgccacgcgggcggcctggggctggcggagcgcgaggcggaggcggaggccgagggctacttccgcaagatgcaggcgcgccgcttccccgactagcgcggcggggccgggggcgggcggggggcgggccgagggcgcgggcggccgcgcggatgctcaataaagcggcagaaaccga

SEQ ID NO: 280243 - DNA, 2173 bp, Homo sapiens
gaggagacgcgctttgtgctgggcgccggccgcgccagccacggcctgcggcgcccgcggcaccatgatctccaccaaggagaagaacaagatcccgaaggacagcatgacgcttctgccctgcttctacttcgtggagctgcccatagtggcttcttccatcgtatccttgtacttcctggagctgaccgacctcttcaagccggccaaggtgggcttccagtgctatgaccgcactctctccatgccctacgtggagaccaacgaggagctcatcccgctgctgatgctgctcagcttggccttcgcggcccctgccgcctcgatcatggtggccgagggcatgttgtactgtctgcagtcccggctgtggggccgtgccggggggcccgccggggcggagggcagcatcaacgccggcggctgcaacttcaactccttcctgcggcgtacggtgcggtttgtgggtgtccacgtgttcggcctgtgtgccacagccctggtgacggacgtgatccagctggccacgggttaccacactcccttcttcctcaccgtctgcaagcccaactacactctcctgggcacgtcctgcgaggtcaacccctacatcacgcaggacatctgctccggccacgacatccacgccatcctgtctgcacggaagaccttcccgtcccagcacgccacgctgtcagccttcgccgcggtctatgtgtcgatgtacttcaactcggtcatctcggacaccaccaagctgctgaagcccatcctggtcttcgcctttgccatcgccgcgggcgtatgcgggctcacgcagatcacgcagtaccgcagccaccctgtggacgtgtatgccggcttcctcatcggggcgggcatcgctgcctacctggcctgccacgcggtgggcaacttccaggccccacctgcagagaagcccgcggccccggcccccgccaaggacgcgctgcgggccctgacgcagcggggccacgactcggtttatcagcagaataagtcggtgagcaccgacgagctggggcccccagggcggctggagggcgcgccccggcccgtggcccgcgagaagaccccgcgcgccgccacatgaccatccacgtgccgctggacgcctcgcgctccaagcagctcatcagcgagtggaagcagaagagcctggagggccgcggcctggggctgcccgacgacgccagccccgggcacctgcgcgcgcccgccgaacccatggcggaggaggaggaagaggaggaggacgaagaggaagaggaggaggaggaagaggaggaggacgagggcccggccccgccctcgctctaccccaccgtgcaggcgcggccggggctggggcctcgggtcatcctcccaccgcgcgcggggccgccgccgctggtgcacatcccggaggagggcgcgcagacgggggccggcctgtcccccaaaagcggcgccggggtgcgcgccaagtggctcatgatggccgagaagagcggggcggcagtggccaaccctccgcggctgctgcaggtcatcgccatgtccaaggctccgggcgcgccgggccccaaggcggccgagacggcgtcgtcgtccagcgccagctccgactcctcgcagtaccggtcgccgtcggaccgcgactccgccagcatcgtgaccatcgacgcgcacgcgccgcaccaccccgtggtgcacctgtcggccggcggcgcgccctgggagtggaaggcggcgggcggcggggccaaggcggaggccgacggcggctacgagctgggggacctggcgcgcggcttccgcggcggggccaagcccccgggcgtgtcccccggctcgtcggtcagcgacgtggaccaggaggagccgcggttcggggccgtggccaccgtcaacctggccacgggcgaggggctgcccccgctgggcgcggccgatggggcgctgggcccgggcagccgggagtccacgctgcggcgccacgcgggcggcctggggctggcggagcgcgaggcggaggcggaggccgagggctacttccgcaagatgcaggcgcgccgcttccccgactagcgcggcggggccgggggcgggcggggggcgggccgagggcgcgggcggccgcgcggatgctcaataaagcggcagaaaccga

SEQ ID NO: 280244 - DNA, 2208 bp, Homo sapiens
gaggagacgcgctttgtgctgggcgccggccgcgccagccacggcctgcggcgcccgcggcaccatgatctccaccaaggagaagaacaagatcccgaaggacagcatgacgcttctgccctgcttctacttcgtggagctgcccatagtggcttcttccatcgtatccttgtacttcctggagctgaccgacctcttcaagccggccaaggtgggcttccagtgctatgaccgcactctctccatgccctacgtggagaccaacgaggagctcatcccgctgctgatgctgctcagcttggccttcgcggcccctgccgcctcgatcatggtggccgagggcatgttgtactgtctgcagtcccggctgtggggccgtgccggggggcccgccggggcggagggcagcatcaacgccggcggctgcaacttcaactccttcctgcggcgtacggtgcggtttgtgggtgtccacgtgttcggcctgtgtgccacagccctggtgacggacgtgatccagctggccacgggttaccacactcccttcttcctcaccgtctgcaagcccaactacactctcctgggcacgtcctgcgaggtcaacccctacatcacgcaggacatctgctccggccacgacatccacgccatcctgtctgcacggaagaccttcccgtcccagcacgccacgctgtcagccttcgccgcggtctatgtgtcgatgtacttcaactcggtcatctcggacaccaccaagctgctgaagcccatcctggtcttcgcctttgccatcgccgcgggcgtatgcgggctcacgcagatcacgcagtaccgcagccaccctgtggacgtgtatgccggcttcctcatcggggcgggcatcgctgcctacctggcctgccacgcggtgggcaacttccaggccccacctgcagagaagcccgcggccccggcccccgccaaggacgcgctgcgggccctgacgcagcggggccacgactcggtttatcagcagaataagtcggtgagcaccgacgagctggggcccccagggcggctggagggcgcgccccggcccgtggcccgcgagaagaccccgcgcgccgccacatgaccatccacgtgccgctggacgcctcgcgctccaagcagctcatcagcgagtggaagcagaagagcctggagggccgcggcctggggctgcccgacgacgccagccccgggcacctgcgcgcgcccgccgaacccatggcggaggaggaggaagaggaggaggacgaagaggaagaggaggaggaggaagaggaggaggacgagggcccggccccgccctcgctctaccccaccgtgcaggcgcggccggggctggggcctcgggtcatcctcccaccgcgcgcggggccgccgccgctggtgcacatcccggaggagggcgcgcagacgggggccggcctgtcccccaaaagcggcgccggggtgcgcgccaagtggctcatgatggccgagaagagcggggcggcagtggccaaccctccgcggctgctgcaggtcatcgccatgtccaaggctccgggcgcgccgggccccaaggcggccgagacggcgtcgtcgtccagcgccagctccgactcctcgcagtaccggtcgccgtcggaccgcgactccgccagcatcgtgaccatcgacgcgcacgcgccgcaccaccccgtggtgcacctgtcggccggcggcgcgccctgggagtggaaggcggcgggcggcggggccaaggcggaggccgacggcggctacgagctgggggacctggcgcgcggcttccgcggcggggccaagcccccgggcgtgtcccccggctcgtcggtcagcgacgtggaccaggaggagccgcggttcggggccgtggccaccgtcaacctggccacgggcgaggggctgcccccgctgggcgcggccgatggggcgctgggcccgggcagccgggagtccacgctgcggcgccacgcgggcggcctggggctggcggagcgcgaggcggaggcggaggccgagggctacttccgcaagatgcaggcgcgccgcttccccgactagcgcggcggggccgggggcgggcggggggcgggccgagggcgcgggcggccgcgcggatgctcaataaagcggcagaaaccgaaaaaaacaacacaaacagaacacacaaaaaaaaac

SEQ ID NO: 280245 - DNA, 932 bp, Homo sapiens
cgacccacgcgtcggactagttctagatcgcgagcagacctcgctgggcagcctgaagcgcgccagcgtggacgtggacctgctggccccgcgcagccccatggccaaggagaacatggtgaccttcagccacacgctgcccagggccagcgcgccctcgctggacgaccccgcgcgccgccacatgaccatccacgtgccgctggacgcctcgcgctccaagcagctcatcagcgagtggaagcagaagagcctggagggccgcggcctggggctgcccgacgacgccagccccgggcacctgcgcgcgcccgccgaacccatggcggaggaggaggaagaggaggaggacgaagaggaagaggaggaggaggaagaggaggaggacgagggcccggccccgccctcgctctaccccaccgtgcaggcgcggccggggctggggcctcgggtcatcctcccaccgcgcgcggggccgccgccgctggtgcacatcccggaggagggcgcgcagacgggggccggcctgtcccccaaaagcggcgccggggtgcgcgccaagtggctcatgatggccgagaagagcggggcggcagtggccaaccctccgcggctgctgcaggtcatcgccatgtccaaggctccgggcgcgccgggccccaaggcggccgagacggcgtcgtcgtccagcgccagctccgactcctcgcagtacgtcgcgtcgacggatcgcagcatgtgacatgagcgcagcgcgacacgcgggtaccgttgcggggcccggaatggaagggggggggggcagcgggggagaggaacggggccgccggtccggggcaccgggttcgttcggagaagagcggggggccaacgccgaggccaggtggcgcaagccaccccgggcaggcgaaaccacggcggctgcgggtttg

SEQ ID NO: 280246 - DNA, 1879 bp, Homo sapiens
gaggagacgcgctttgtgctgggcgccggccgcgccagccacggcctgcggcgcccgcggcaccatgatctccaccaaggagaagaacaagatcccgaaggacagcatgacgcttctgccctgcttctacttcgtggagctgcccatagtggcttcttccatcgtatccttgtacttcctggagctgaccgacctcttcaagccggccaaggtgggcttccagtgctatgaccgcactctctccatgccctacgtggagaccaacgaggagctcatcccgctgctgatgctgctcagcttggccttcgcggcccctgccgcctcgatcatggtggccgagggcatgttgtactgtctgcagtcccggctgtggggccgtgccggggggcccgccggggcggagggcagcatcaacgccggcggctgcaacttcaactccttcctgcggcgtacggtgcggtttgtgggtgtccacgtgttcggcctgtgtgccacagccctggtgacggacgtgatccagctggccacgggttaccacactcccttcttcctcaccgtctgcaagcccaactacactctcctgggcacgtcctgcgaggtcaacccctacatcacgcaggacatctgctccggccacgacatccacgccatcctgtctgcacggaagaccttcccgtcccagcacgccacgctgtcagccttcgccgcggtctatgtgtcgatgtacttcaactcggtcatctcggacaccaccaagctgctgaagcccatcctggtcttcgcctttgccatcgccgcgggcgtatgcgggctcacgcagatcacgcagtaccgcagccaccctgtggacgtgtatgccggcttcctcatcggggcgggcatcgctgcctacctggcctgccacgcggtgggcaacttccaggccccacctgcagagaagcccgcggccccggcccccgccaaggacgcgctgcgggccctgacgcagcggggccacgactcggtttatcagcagaataagtcggtgagcaccgacgagctggggcccccagggcggctggagggcgcgccccggcccgtggcccgcgagaagacctcgctgggcagcctgaagcgcgccagcgtggacgtggacctgctggccccgcgcagccccatggccaaggagaacatggtgaccttcagccacacgctgcccagggccagcgcgccctcgctggacgaccccgcgcgccgccacatgaccatccacgtgccgctggacgcctcgcgctccaagcagctcatcagcgagtggaagcagaagagcctggagggccgcggcctggggctgcccgacgacgccagccccgggcacctgcgcgcgcccgccgaacccatggcggaggaggaggaagaggaggaggacgaagaggaagaggaggaggaggaagaggaggaggacgagggcccggccccgccctcgctctaccccaccgtgcaggcgcggccggggctggggcctcgggtcatcctcccaccgcgcgcggggccgccgccgctggtgcacatcccggaggagggcgcgcagacgggggccggcctgtcccccaaaagcggcgccggggtgcgcgccaagtggctcatgatggccgagaagagcggggcggcagtggccaaccctccgcggctgctgcaggtcatcgccattccacgctgcggcgccacgcgggcggcctggggctggcggagcgcgaggcggaggcggaggccgagggctacttccgcaagatgcaggcgcgccgcttccccgactagcgcggcggggccgggggcgggcggggggcgggccgagggcgcgggcggccgcgcggatgctcaataaagcggcagaaaccga

SEQ ID NO: 280247 - DNA, 863 bp, Homo sapiens
gaggagacgcgctttgtgctgggcgccggccgcgccagccacggcctgcggcgcccgcggcaccatgatctccaccaaggagaagaacaagatcccgaaggacagcatgacgcttctgccctgcttctacttcgtggagctgcccatagtggcttcttccatcgtatccttgtacttcctggagctgaccgacctcttcaagccggccaaggtgggcttccagtgctatgaccgcactctctccatgccctacgtggagaccaacgaggagctcatcccgctgctgatgctgctcagcttggccttcgcggcccctgccgcctcgatcatggtggccgagggcatgttgtactgtctgcagtcccggctgtggggccgtgccggggggcccgccggggcggagggcagcatcaacgccggcggctgcaacttcaactccttcctgcggcgtacggtgcggtttgtgggtgtccacgtgttcggcctgtgtgccacagccctggtgacggacgtgatccagctggccacgggttaccacactcccttcttcctcaccgtctgcaagcccaactacactctcctgggcacgtcctgcgaggtcaacccctacatcacgcaggacatctgctccggccacgacatccacgccatcctgtctgcacggaagaccttcccgtcccagcacgccacggcgggcggcctggggctggcggagcgcgaggcggaggcggaggccgagggctacttccgcaagatgcaggcgcgccgcttccccgactagcgcggcggggccgggggcgggcggggggcgggccgagggcgcgggcggccgcgcggatgctcaataaagcggcagaaaccga

SEQ ID NO: 280248 - DNA, 1026 bp, Homo sapiens
gtgaaggtctcagtgaaccaagatagcaccactgcactccagcctgggcaacagagcaagactccatctcaaaaacaaaaagtccacataaatgcaggaagaacttagacaatgcctgaaatgcaaaggcgacactggagtcttctttctctaacgtgtagcgttgaatgaatatctgcctggaaccaagagggctgctctgatgtttgggagtcggttttttgtgagccacatctgatatttctgatatccccaggaaggagtggcctggaggtcactggttcaggctccctttgggcgaaatcctgggagtgatgctctaaaaatccacctttcccatcatccctactcatcagaaagacaaatataaaatcccagagaggtggaggagctaaaaaagcaattgctccaccttacaaatttggatagaaaggagatgtagtttatttcatatgggcaaagtagtcctcttccaaagtcctgtacagttgttctctgcaattgacgcacatctgccctaagcgaaatctgtcagaaggaatcaacaaggctccttgcctcccctcccaatcccccttttggaggacttgtggcttcagtgtcgtcctaagtgagagtggcgtgtgcttttttcctgtcccctcctccctccgtgtcctagacgctggctgccttctgtgcactcccaggcagatcactacggaagagtcggagcctgtggggttggactggccacactcagtcctgagaaggcgagttgccatggaaagctgggggcagaggtgtttttggagaggaggcggcaggcaaacattgcctttgacttgctctccgcgtacccggggttgtagagctgctcaggaaggggcaggatgtaaggccagaggtgcctggtgggtgagaagcccaggcagggctgggcgccctctccgaagaggtggcagcagggtgaccctgaactcccaaatggggagtgatgccactggggaaactgagtggatcaaagagatgaaaccaaaaaaaagc

SEQ ID NO: 280249 - DNA, 6272 bp, Homo sapiens
  misc_feature (2117)..(2117): n is a, c, g, or t
  misc_feature (2120)..(2120): n is a, c, g, or t
cctgcctgcccccaaaatgtgaagcttgctgaaatcaacttgaaaggagatagcacatgccttttgtttctccgctctccccctatttctcttccttcctgctccctgcataatctgaattctctgaaggcaggggtcctgtcttactcatcttgatgttcatcgtgactcgtacagcagcggcggcagcggcagcccagccgagcgttaggtgctgctctctgcgcggcgttttgcaaaggacttcaccgatctacttttgcagtcgcctcggactgtccatgtgtttacttcccccagcccgaggattcgatatctaggttcctgtgaaatgcaactgagcagccaaagtactttgagaacacggggcggcataaacaccaaaacttttttgtggaaggaaaatgcaataagcaagcttgccgttttccgatgcggtgtggagtgagtgtgtgtcgcgcgtgtccgcactggaggcatatgcttgtgtgtgtacatggggtgtgtttttcggtatgtagggagaaaatgcttgccaaccaccggaaatctcctggaatttattagaaaataatggattataaaaagaaggcaagcaaggagcggatctccccttgagttgcaacccgatttgctgctggctcagtttgttgtgattctttttgttgataggtgtctgatggtattccgataacgttccccccttttcttccccttgagcttttacagtttaaaaaaaggaaacaaaaaccaccccaaaatctccccccccgtttttttcgccccgtcgggatcgccgtttccatccatgtgcttgcgtctcccccgcgttccacttaaactattttaatccttggacccaaggaggaggctgataggggggtggataaaaaaagttcttccaaaatagtgtgcccggggagcaggatgggggatttcgcagcccccgctgctgccgcgaatggcagtagtatttgcatcaacagtagcctgaacagcagcctcggcggggccgggatcggtgtgaataatactcccaatagtactcccgctgctccgagtagcaatcacccggcagccggtggatgcggcggctccgggggccccggcggcggttcggcggccgttcccaagcacagcaccgtggtggagcggctccgccagcgcatcgagggctgccgtcggcaccacgtcaactgcgagaacaggtaccagcaggctcaggtggagcagctggagctggagcgccgggacaccgtgagcctctaccagcggaccctggagcagagggccaagaaatcgggcgccggcaccggcaaacagcagcacccgagcaaaccccagcaagatgcggaggctgcctcggcggagcagaggaaccacacgctgatcatgctacaagagactgtgaaaaggaagttggaaggagctcgatcaccacttaatggagaccagcagaatggtgcttgtgatgggaatttttctccgactagcaaacgaattcgaaaggacatttctgcggggatggaagccatcaacaatttgcccagtaacatgccactgccttcagcttctcctcttcaccaacttgacctgaaaccttctttgcccttgcagaacagtggaactcacactcctgggcttctagaagatctaagtaagaatggtaggctccctgagattaaacttcctgtcaacggttgcagtgacctggaggatagcttcaccatcttgcagagcaaagacctcaaacaagaacctctcgatgaccctacttgcatagacacatcagaaacatctctttcaaatcagaacaagctgttctcagacattaatctgaatgatcaggagtggcaagaattaatagatgaattggccaacacggttcctgaggatgacatacaggacctgttcaacgaagactttgaagagaagaaggagccagaattctcgcagccagcaactgagacccctctctcccaggagagtgcgagcgtgaagagcgacccctctcactctcccttcgcacatgtctccatgggatctccccaggcgaggccttcttcttctggtcctcccttttctactgtctccacggccactagtttaccttctgntgncagcactcccgcagctccaaaccctgcaagctcaccagcaaactgtgctgtccagtcccctcaaactccaaaccaagcccacactccaggccaagctccacctcggcctggaaatggttatctcctgaatccggcagcagtgacagtggccggttcagcgtcagggcctgtggctgtgcccagctctgacatgtctccagcagaacagctcaaacagatggctgcacagcagcaacaaagggccaaactcatgcagcagaagcagcaacagcaacagcagcagcagcagcagcagcagcaacagcagcagcagcagcagcaacagcactcaaatcagacttcaaattggtctcccttaggacctccctctagtccatatggagcagcttttactgcagaaaaaccaaatagcccaatgatgtacccccaagcctttaacaaccaaaaccctatagtgcctccaatggcaaacaacctgcagaagacaacaatgaataactacctccctcagaatcacatgaatatgatcaatcagcagccaaataacttgggtacaaactccttaaacaaacagcacaatattctgacttatggcaacactaaacccctgacccacttcaatgcagacctgagtcagaggatgacaccaccagtggccaaccccaacaaaaaccccttgatgccgtatatccagcagcagcaacagcagcagcaacagcaacagcagcagcagcagcagcagcagccgccacctccacagctccaggcccccagggcacacctgagcgaagaccagaaacgcctgcttctcatgaagcagaaaggagtgatgaatcagcccatggcttacgctgcacttccatcccacggtcaggagcagcatccagttggacttccccgaaccacaggccccatgcagtcctccgtgcccccaggctcaggtggcatggtctcaggagccagtcccgcaggccccggcttcctgggcagccagccccaagcagccatcatgaagcagatgctcattgatcagcgggcccagttgatagagcagcagaagcaacagttcctgcgggagcaaagcgcagcagcagcagcagcagcagcagattttggcggaacagcagttgcagcaatcacatctaccccggcagcacctccagccacagcggaatccatacccagtgcagcaggtcaatcagtttcaaggttctccccaggatatagcagccgtaagaagccaagcagccctccagagcatgcgaacgtcacggctgatggcacagaacgcaggcatgatgggaataggaccctcccagaaccctgggacgatggccaccgcagctgcgcagtcggagatgggactggccccttatagcaccacgcctaccagccaaccaggaatgtacaatatgagcacaggcatgacccaaatgttgcagcatccaaaccaaagtggcatgagcatcacacataaccaagcccagggaccgaggcaacctgcctctgggcagggggttggaatggtgagtggctttggtcagagcatgctggtgaactcagccattacccagcaacatccacagatgaaagggccagtaggccaggccttgcctaggccccaagcccctccaaggctgcagagccttatgggaacagtccagcaaggagcacaaagctggcaacagaggagcttgcagggcatgcctgggaggactagtggagaattgggaccattcaacaatggcgccagctaccctcttcaagctgggcagccgagactgaccaagcagcacttcccacagggactgagccagtcagtcgtggatgctaacacgggcacagtgaggaccctcaacccagctgccatgggtcggcagatgatgccatcgctcccggggcagcaaggcaccagccaggcgaggccaatggtcatgtctggcctgagccagggagtcccaggcatgccagcgttcagccagcccccagcacagcagcagatacccagtggcagctttgctccaagcagccagagccaagcctatgagcggaatgcccctcaggacgtgtcatacaattacagtggcgacggagctgggggttccttccctggcctcccggacggtgcagaccttgtggactccatcatcaaaggcgggccaggggacgagtggatgcaggagcttgatgaattgtttggtaacccctaatcaagagaggccccaagatccacaactcgagtggttaaagcttaaaaagtgaaaaagaaacaggatgttgacccatccttgttttttgtttttttgacccacgtaaactgagcaaaactgcagctggctgacaatggaagatccaggtgccaatccacagccccaccaggcctcatttcacctgattttcacacagcaatcgagatgagacgccatgcagatcccggctgcgagagagggagacacccggaggagcaggtgggaagatgaagccggccagagcccctctgcccagcatgccctgtgatcgcctggcccagcaggagctgcttcagccgagagggactattacccaagagaggtatcctcagcccctcctgccccaggtcgggagacagcagctttggagacacaaaagagacagagcctcagccagggagagtgagtcccccagaagaggctgggtggttgcacaggccaggtgcacaggttggaaatgcactgaactctgggtgccgagagatgtaaggctttgagacatgctactgaatttggagggcaggcacgaagaacagtgagattgtcaaaaggagacaaccacagatcctacaggactgtctgtctcctgccccatgatgaccctcaggaattgcaaaggctctgctgtcacaaggagagcaggctgagtttggagcagggtccatccggcagtcctgggacggcttccctctgctggtgcccctggtggcagtccctccaggtggggctggagcctgctggcgcccaatacaaaacccatacatccaggtgggtcacatctacttctggcggccgcagggcagggaaacccctactggaccctgtgtgtctgccagcctggagcctttgtctccagccctgcctttattcctccttgcctccacaccagcctccccttgcttctccttacagactatccaagaagtgaagcttatgtctttagggagccttgggcagagtccacataaatgcaggaagaacttagacaatgcctgaaatgcaaaggcgacactggagtcttctttctctaacgtgtagcgttgaatgaatatctgcctggaaccaagagggctgctctgatgtttgggagtcggttttttgtgagccacatctgatatttctgatatccccaggaaggagtggcctggaggtcactggttcaggctccctttgggcgaaatcctgggagtgatgctctaaaaatccacctttcccatcatccctactcatcagaaagacaaatataaaatcccagagaggtggaggagctaaaaaagcaattgctccaccttacaaatttggatagaaaggagatgtagtttatttcatatgggcaaagtagtcctcttccaaagtcctgtacagttgttctctgcaattgacgcacatctgccctaagcgaaatctgtcagaaggaatcaacaaggctccttgcctcccctcccaatcccccttttggaggacttgtggcttcagtgtcgtcctaagtgagagtggcgtgtgcttttttcctgtcccctcctccctccgtgtcctagacgctggctgccttctgtgcactcccaggcagatcactacggaagagtcggagcctgtggggttggactggccacactcagtcctgagaaggcgagttgccatggaaagctgggggcagaggtgtttttggagaggaggcggcaggcaaacattgcctttgacttgctctccgcgtacccggggttgtagagctgctcaggaaggggcaggatgtaaggccagaggtgcctggtgggtgagaagcccaggcagggctgggcgccctctccgaagaggtggcagcagggtgaccctgaactcccaaatggggagtgatgccactggggaaactgagtggatcaaagagatgaaaccaaaaaaaagc

SEQ ID NO: 280250 - DNA, 5806 bp, Homo sapiens
  misc_feature (2117)..(2117): n is a, c, g, or t
  misc_feature (2120)..(2120): n is a, c, g, or t
cctgcctgcccccaaaatgtgaagcttgctgaaatcaacttgaaaggagatagcacatgccttttgtttctccgctctccccctatttctcttccttcctgctccctgcataatctgaattctctgaaggcaggggtcctgtcttactcatcttgatgttcatcgtgactcgtacagcagcggcggcagcggcagcccagccgagcgttaggtgctgctctctgcgcggcgttttgcaaaggacttcaccgatctacttttgcagtcgcctcggactgtccatgtgtttacttcccccagcccgaggattcgatatctaggttcctgtgaaatgcaactgagcagccaaagtactttgagaacacggggcggcataaacaccaaaacttttttgtggaaggaaaatgcaataagcaagcttgccgttttccgatgcggtgtggagtgagtgtgtgtcgcgcgtgtccgcactggaggcatatgcttgtgtgtgtacatggggtgtgtttttcggtatgtagggagaaaatgcttgccaaccaccggaaatctcctggaatttattagaaaataatggattataaaaagaaggcaagcaaggagcggatctccccttgagttgcaacccgatttgctgctggctcagtttgttgtgattctttttgttgataggtgtctgatggtattccgataacgttccccccttttcttccccttgagcttttacagtttaaaaaaaggaaacaaaaaccaccccaaaatctccccccccgtttttttcgccccgtcgggatcgccgtttccatccatgtgcttgcgtctcccccgcgttccacttaaactattttaatccttggacccaaggaggaggctgataggggggtggataaaaaaagttcttccaaaatagtgtgcccggggagcaggatgggggatttcgcagcccccgctgctgccgcgaatggcagtagtatttgcatcaacagtagcctgaacagcagcctcggcggggccgggatcggtgtgaataatactcccaatagtactcccgctgctccgagtagcaatcacccggcagccggtggatgcggcggctccgggggccccggcggcggttcggcggccgttcccaagcacagcaccgtggtggagcggctccgccagcgcatcgagggctgccgtcggcaccacgtcaactgcgagaacaggtaccagcaggctcaggtggagcagctggagctggagcgccgggacaccgtgagcctctaccagcggaccctggagcagagggccaagaaatcgggcgccggcaccggcaaacagcagcacccgagcaaaccccagcaagatgcggaggctgcctcggcggagcagaggaaccacacgctgatcatgctacaagagactgtgaaaaggaagttggaaggagctcgatcaccacttaatggagaccagcagaatggtgcttgtgatgggaatttttctccgactagcaaacgaattcgaaaggacatttctgcggggatggaagccatcaacaatttgcccagtaacatgccactgccttcagcttctcctcttcaccaacttgacctgaaaccttctttgcccttgcagaacagtggaactcacactcctgggcttctagaagatctaagtaagaatggtaggctccctgagattaaacttcctgtcaacggttgcagtgacctggaggatagcttcaccatcttgcagagcaaagacctcaaacaagaacctctcgatgaccctacttgcatagacacatcagaaacatctctttcaaatcagaacaagctgttctcagacattaatctgaatgatcaggagtggcaagaattaatagatgaattggccaacacggttcctgaggatgacatacaggacctgttcaacgaagactttgaagagaagaaggagccagaattctcgcagccagcaactgagacccctctctcccaggagagtgcgagcgtgaagagcgacccctctcactctcccttcgcacatgtctccatgggatctccccaggcgaggccttcttcttctggtcctcccttttctactgtctccacggccactagtttaccttctgntgncagcactcccgcagctccaaaccctgcaagctcaccagcaaactgtgctgtccagtcccctcaaactccaaaccaagcccacactccaggccaagctccacctcggcctggaaatggttatctcctgaatccggcagcagtgacagtggccggttcagcgtcagggcctgtggctgtgcccagctctgacatgtctccagcagaacagctcaaacagatggctgcacagcagcaacaaagggccaaactcatgcagcagaagcagcaacagcaacagcagcagcagcagcagcagcagcaacagcagcagcagcagcagcaacagcactcaaatcagacttcaaattggtctcccttaggacctccctctagtccatatggagcagcttttactgcagaaaaaccaaatagcccaatgatgtacccccaagcctttaacaaccaaaaccctatagtgcctccaatggcaaacaacctgcagaagacaacaatgaataactacctccctcagaatcacatgaatatgatcaatcagcagccaaataacttgggtacaaactccttaaacaaacagcacaatattctgacttatggcaacactaaacccctgacccacttcaatgcagacctgagtcagaggatgacaccaccagtggccaaccccaacaaaaaccccttgatgccgtatatccagcagcagcaacagcagcagcaacagcaacagcagcagcagcagcagcagcagccgccacctccacagctccaggcccccagggcacacctgagcgaagaccagaaacgcctgcttctcatgaagcagaaaggagtgatgaatcagcccatggcttacgctgcacttccatcccacggtcaggagcagcatccagttggacttccccgaaccacaggccccatgcagtcctccgtgcccccaggctcaggtggcatggtctcaggagccagtcccgcaggccccggcttcctgggcagccagccccaagcagccatcatgaagcagatgctcattgatcagcgggcccagttgatagagcagcagaagcaacagttcctgcgggagcaaagcgcagcagcagcagcagcagcagcagattttggcggaacagcagttgcagcaatcacatctaccccggcagcacctccagccacagcggaatccatacccagtgcagcaggtcaatcagtttcaaggttctccccaggatatagcagccgtaagaagccaagcagccctccagagcatgcgaacgtcacggctgatggcacagaacgcaggcatgatgggaataggaccctcccagaaccctgggacgatggccaccgcagctgcgcagtcggagatgggactggccccttatagcaccacgcctaccagccaaccaggaatgtacaatatgagcacaggcatgacccaaatgttgcagcatccaaaccaaagtggcatgagcatcacacataaccaagcccagggaccgaggcaacctgcctctgggcagggggttggaatggtgagtggctttggtcagagcatgctggtgaactcagccattacccagcaacatccacagatgaaagggccagtaggccaggccttgcctaggccccaagcccctccaaggctgcagagccttatgggaacagtccagcaaggagcacaaagctggcaacagaggagcttgcagggcatgcctgggaggactagtggagaattgggaccattcaacaatggcgccagctaccctcttcaagctgggcagccgagactgaccaagcagcacttcccacagggactgagccagtcagtcgtggatgctaacacgggcacagtgaggaccctcaacccagctgccatgggtcggcagatgatgccatcgctcccggggcagcaaggcaccagccaggcgaggccaatggtcatgtctggcctgagccagggagtcccaggcatgccagcgttcagccagcccccagcacagcagcagatacccagtggcagctttgctccaagcagccagagccaagcctatgagcggaatgcccctcaggacgtgtcatacaattacagtggcgacggagctgggggttccttccctggcctcccggacggtgcagaccttgtggactccatcatcaaaggcgggccaggggacgagtggatgcaggagcttgatgaattgtttggtaacccctaatcaagagaggccccaagatccacaactcgagtggttaaagcttaaaaagtgaaaaagaaacaggatgttgacccatccttgttttttgtttttttgacccacgtaaactgagcaaaactgcagctggctgacaatggaagatccaggtgccaatccacagccccaccaggcctcatttcacctgattttcacacagcaatcgagatgagacgccatgcagatcccggctgcgagagagggagacacccggaggagcaggtgggaagatgaagccggccagagcccctctgcccagcatgccctgtgatcgcctggcccagcaggagctgcttcagccgagagggactattacccaagagaggtatcctcagcccctcctgccccaggtcgggagacagcagctttggagacacaaaagagacagagcctcagccagggagagtgagtcccccagaagaggctgggtggttgcacaggccaggtgcacaggttggaaatgcactgaactctgggtgccgagagatgtaaggctttgagacatgctactgaatttggagggcaggcacgaagaacagtgagattgtcaaaaggagacaaccacagatcctacaggactgtctgtctcctgccccatgatgaccctcaggaattgcaaaggctctgctgtcacaaggagagcaggctgagtttggagcagggtccatccggcagtcctgggacggcttccctctgctggtgcccctggtggcagtccctccaggtggggctggagcctgctggcgcccaatacaaaacccatacatccaggtgggtcacatctacttctggcggccgcagggcagggaaacccctactggaccctgtgtgtctgccagcctggagcctttgtctccagccctgcctttattcctccttgcctccacaccagcctccccttgcttctccttacagactatccaagaagtgaagcttatgtctttagggagccttgggcagagtccacataaatgcaggaagaacttagacaatgcctgaaatgcaaaggcgacactggagtcttctttctctaacgtgtgcttttttcctgtcccctcctccctccgtgtcctagacgctggctgccttctgtgcactcccaggcagatcactacggaagagtcggagcctgtggggttggactggccacactcagtcctgagaaggcgagttgccatggaaagctgggggcagaggtgtttttggagaggaggcggcaggcaaacattgcctttgacttgctctccgcgtacccggggttgtagagctgctcaggaaggggcaggatgtaaggccagaggtgcctggtgggtgagaagcccaggcagggctgggcgccctctccgaagaggtggcagcagggtgaccctgaactcccaaatggggagtgatgccactggggaaactgagtggatcaaagagatgaaaccaaaaaaaagc

SEQ ID NO: 280251 - DNA, 3797 bp, Homo sapiens
  misc_feature (2117)..(2117): n is a, c, g, or t
  misc_feature (2120)..(2120): n is a, c, g, or t
  misc_feature (3491)..(3491): n is a, c, g, or t
  misc_feature (3506)..(3506): n is a, c, g, or t
  misc_feature (3540)..(3540): n is a, c, g, or t
  misc_feature (3664)..(3664): n is a, c, g, or t
  misc_feature (3666)..(3666): n is a, c, g, or t
  misc_feature (3669)..(3669): n is a, c, g, or t
  misc_feature (3671)..(3671): n is a, c, g, or t
cctgcctgcccccaaaatgtgaagcttgctgaaatcaacttgaaaggagatagcacatgccttttgtttctccgctctccccctatttctcttccttcctgctccctgcataatctgaattctctgaaggcaggggtcctgtcttactcatcttgatgttcatcgtgactcgtacagcagcggcggcagcggcagcccagccgagcgttaggtgctgctctctgcgcggcgttttgcaaaggacttcaccgatctacttttgcagtcgcctcggactgtccatgtgtttacttcccccagcccgaggattcgatatctaggttcctgtgaaatgcaactgagcagccaaagtactttgagaacacggggcggcataaacaccaaaacttttttgtggaaggaaaatgcaataagcaagcttgccgttttccgatgcggtgtggagtgagtgtgtgtcgcgcgtgtccgcactggaggcatatgcttgtgtgtgtacatggggtgtgtttttcggtatgtagggagaaaatgcttgccaaccaccggaaatctcctggaatttattagaaaataatggattataaaaagaaggcaagcaaggagcggatctccccttgagttgcaacccgatttgctgctggctcagtttgttgtgattctttttgttgataggtgtctgatggtattccgataacgttccccccttttcttccccttgagcttttacagtttaaaaaaaggaaacaaaaaccaccccaaaatctccccccccgtttttttcgccccgtcgggatcgccgtttccatccatgtgcttgcgtctcccccgcgttccacttaaactattttaatccttggacccaaggaggaggctgataggggggtggataaaaaaagttcttccaaaatagtgtgcccggggagcaggatgggggatttcgcagcccccgctgctgccgcgaatggcagtagtatttgcatcaacagtagcctgaacagcagcctcggcggggccgggatcggtgtgaataatactcccaatagtactcccgctgctccgagtagcaatcacccggcagccggtggatgcggcggctccgggggccccggcggcggttcggcggccgttcccaagcacagcaccgtggtggagcggctccgccagcgcatcgagggctgccgtcggcaccacgtcaactgcgagaacaggtaccagcaggctcaggtggagcagctggagctggagcgccgggacaccgtgagcctctaccagcggaccctggagcagagggccaagaaatcgggcgccggcaccggcaaacagcagcacccgagcaaaccccagcaagatgcggaggctgcctcggcggagcagaggaaccacacgctgatcatgctacaagagactgtgaaaaggaagttggaaggagctcgatcaccacttaatggagaccagcagaatggtgcttgtgatgggaatttttctccgactagcaaacgaattcgaaaggacatttctgcggggatggaagccatcaacaatttgcccagtaacatgccactgccttcagcttctcctcttcaccaacttgacctgaaaccttctttgcccttgcagaacagtggaactcacactcctgggcttctagaagatctaagtaagaatggtaggctccctgagattaaacttcctgtcaacggttgcagtgacctggaggatagcttcaccatcttgcagagcaaagacctcaaacaagaacctctcgatgaccctacttgcatagacacatcagaaacatctctttcaaatcagaacaagctgttctcagacattaatctgaatgatcaggagtggcaagaattaatagatgaattggccaacacggttcctgaggatgacatacaggacctgttcaacgaagactttgaagagaagaaggagccagaattctcgcagccagcaactgagacccctctctcccaggagagtgcgagcgtgaagagcgacccctctcactctcccttcgcacatgtctccatgggatctccccaggcgaggccttcttcttctggtcctcccttttctactgtctccacggccactagtttaccttctgntgncagcactcccgcagctccaaaccctgcaagctcaccagcaaactgtgctgtccagtcccctcaaactccaaaccaagcccacactccaggccaagctccacctcggcctggaaatggttatctcctgaatccggcagcagtgacagtggccggttcagcgtcagggcctgtggctgtgcccagctctgacatgtctccagcagaacagctcaaacagatggctgcacagcagcaacaaagggccaaactcatgcagcagaagcagcaacaacagcagcagcagcagcagcaacagcactcaaatcagacttcaaattggtctcccttaggacctccctctagtccatatggagcagcttttactgcagaaaaaccaaatagcccaatgatgtacccccaagcctttaacaaccaaaaccctatagtgcctccaatggcaaacaacctgcagaagacaacaatgaataactacctccctcagaatcacatgaatatgatcaatcagcagccaaataacttgggtacaaactccttaaacaaacagcacaatattctgacttatggcaacactaaacccctgacccacttcaatgcagacctgagtcagaggatgacaccaccagtggccaaccccaacaaaaaccccttgatgccgtatatccagcagcagcaacagcagcagcaacagcaacagcagcagcagcagcagcagcagccgccacctccacagctccaggcccccagggcacacctgagcgaagaccagaaacgcctgcttctcatgaagcagaaaggagtgatgaatcagcccatggcttacgctgcacttccatcccacggtcaggtaagtgtgaaagtgacacactcttcgagcagttcttgtggtgcatttcaagactgtcgatgtgtgatgttctacaaagcttccactgtagtggggtctaattgcctgcagaaaacctctttacaacatcctcaggtagtggccaggtttggagtgttctttttccatttctcctaagaaatggaaaagggtggcatgataaactttcgtgtatttcagtgtctaggaatcaaacttcttttattcccaactgcagataagaattacataaaattctcactctgagggagggaggctgcagaggtcactccaccaaacacggcactacctctgtagcttctctcccagcttgcatgatcccaggctctgggtggtgggaagcaggggacattcagggctgtctacaacagttttataaggccctgagcagccttcgagttttttaaattttattttagtgaatacatgcattaaaataaaacaacaacaacaacaacaacaaaaacacaaagaggctagagatttcnccgtttctacccccnaaataacgcttgctatcaagactttggagggggntgggggaaaagaatttaaaagccaaataatttttttttcataaaaagtaaaagctaccataaaacatttttttttctgtcacactgattaaatttcttctgaaaagccgcacatatagacaaancnaancnaaaattcctgaactggacaaacagcaaatactcaacagggttgttaacctaggtaacagttcagtagtttaaagaatcttttagacatctggaagcctttctattcattcctcagtacagtgttcc

SEQ ID NO: 280252 - DNA, 4112 bp, Homo sapiens
aaacttacggctaggtacgaggctgggtttgaatcggccgaggctccaggccaagctccacctcggcctggaaatggttatctcctgaatccggcagcagtgacagtggccggttcagcgtcagggcctgtggctgtgcccagctctgacatgtctccagcagaacagctcaaacagatggctgcacagcagcaacaaagggccaaactcatgcagcagaagcagcaacagcaacagcagcagcagcagcagcagcagcaacagcagcagcagcagcagcaacagcactcaaatcagacttcaaattggtctcccttaggacctccctctagtccatatggagcagcttttactgcagaaaaaccaaatagcccaatgatgtacccccaagcctttaacaaccaaaaccctatagtgcctccaatggcaaacaacctgcagaagacaacaatgaataactacctccctcagaatcacatgaatatgatcaatcagcagccaaataacttgggtacaaactccttaaacaaacagcacaatattctgacttatggcaacactaaacccctgacccacttcaatgcagacctgagtcagaggatgacaccaccagtggccaaccccaacaaaaaccccttgatgccgtatatccagcagcagcaacagcagcagcaacagcaacagcagcagcagcagcagcagcagccgccacctccacagctccaggcccccagggcacacctgagcgaagaccagaaacgcctgcttctcatgaagcagaaaggagtgatgaatcagcccatggcttacgctgcacttccatcccacggtcaggagcagcatccagttggacttccccgaaccacaggccccatgcagtcctccgtgcccccaggctcaggtggcatggtctcaggagccagtcccgcaggccccggcttcctgggcagccagccccaagcagccatcatgaagcagatgctcattgatcagcgggcccagttgatagagcagcagaagcaacagttcctgcgggagcaaagcgcagcagcagcagcagcagcagcagattttggcggaacagcagttgcagcaatcacatctaccccggcagcacctccagccacagcggaatccatacccagtgcagcaggtcaatcagtttcaaggttctccccaggatatagcagccgtaagaagccaagcagccctccagagcatgcgaacgtcacggctgatggcacagaacgcaggcatgatgggaataggaccctcccagaaccctgggacgatggccaccgcagctgcgcagtcggagatgggactggccccttatagcaccacgcctaccagccaaccaggaatgtacaatatgagcacaggcatgacccaaatgttgcagcatccaaaccaaagtggcatgagcatcacacataaccaagcccagggaccgaggcaacctgcctctgggcagggggttggaatggtgagtggctttggtcagagcatgctggtgaactcagccattacccagcaacatccacagatgaaagggccagtaggccaggccttgcctaggccccaagcccctccaaggctgcagagccttatgggaacagtccagcaaggagcacaaagctggcaacagaggagcttgcagggcatgcctgggaggactagtggagaattgggaccattcaacaatggcgccagctaccctcttcaagctgggcagccgagactgaccaagcagcacttcccacagggactgagccagtcagtcgtggatgctaacacgggcacagtgaggaccctcaacccagctgccatgggtcggcagatgatgccatcgctcccggggcagcaaggcaccagccaggcgaggccaatggtcatgtctggcctgagccagggagtcccaggcatgccagcgttcagccagcccccagcacagcagcagatacccagtggcagctttgctccaagcagccagagccaagcctatgagcggaatgcccctcaggacgtgtcatacaattacagtggcgacggagctgggggttccttccctggcctcccggacggtgcagaccttgtggactccatcatcaaaggcgggccaggggacgagtggatgcaggagcttgatgaattgtttggtaacccctaatcaagagaggccccaagatccacaactcgagtggttaaagcttaaaaagtgaaaaagaaacaggatgttgacccatccttgttttttgtttttttgacccacgtaaactgagcaaaactgcagctggctgacaatggaagatccaggtgccaatccacagccccaccaggcctcatttcacctgattttcacacagcaatcgagatgagacgccatgcagatcccggctgcgagagagggagacacccggaggagcaggtgggaagatgaagccggccagagcccctctgcccagcatgccctgtgatcgcctggcccagcaggagctgcttcagccgagagggactattacccaagagaggtatcctcagcccctcctgccccaggtcgggagacagcagctttggagacacaaaagagacagagcctcagccagggagagtgagtcccccagaagaggctgggtggttgcacaggccaggtgcacaggttggaaatgcactgaactctgggtgccgagagatgtaaggctttgagacatgctactgaatttggagggcaggcacgaagaacagtgagattgtcaaaaggagacaaccacagatcctacaggactgtctgtctcctgccccatgatgaccctcaggaattgcaaaggctctgctgtcacaaggagagcaggctgagtttggagcagggtccatccggcagtcctgggacggcttccctctgctggtgcccctggtggcagtccctccaggtggggctggagcctgctggcgcccaatacaaaacccatacatccaggtgggtcacatctacttctggcggccgcagggcagggaaacccctactggaccctgtgtgtctgccagcctggagcctttgtctccagccctgcctttattcctccttgcctccacaccagcctccccttgcttctccttacagactatccaagaagtgaagcttatgtctttagggagccttgggcagagtccacataaatgcaggaagaacttagacaatgcctgaaatgcaaaggcgacactggagtcttctttctctaacgtgtagcgttgaatgaatatctgcctggaaccaagagggctgctctgatgtttgggagtcggttttttgtgagccacatctgatatttctgatatccccaggaaggagtggcctggaggtcactggttcaggctccctttgggcgaaatcctgggagtgatgctctaaaaatccacctttcccatcatccctactcatcagaaagacaaatataaaatcccagagaggtggaggagctaaaaaagcaattgctccaccttacaaatttggatagaaaggagatgtagtttatttcatatgggcaaagtagtcctcttccaaagtcctgtacagttgttctctgcaattgacgcacatctgccctaagcgaaatctgtcagaaggaatcaacaaggctccttgcctcccctcccaatcccccttttggaggacttgtggcttcagtgtcgtcctaagtgagagtggcgtgtgcttttttcctgtcccctcctccctccgtgtcctagacgctggctgccttctgtgcactcccaggcagatcactacggaagagtcggagcctgtggggttggactggccacactcagtcctgagaaggcgagttgccatggaaagctgggggcagaggtgtttttggagaggaggcggcaggcaaacattgcctttgacttgctctccgcgtacccggggttgtagagctgctcaggaaggggcaggatgtaaggccagaggtgcctggtgggtgagaagcccaggcagggctgggcgccctctccgaagaggtggcagcagggtgaccctgaactcccaaatggggagtgatgccactggggaaactgagtggatcaaagagatgaaaccaaaaaaaagc

SEQ ID NO: 280253 - DNA, 3906 bp, Homo sapiens
  misc_feature (2117)..(2117): n is a, c, g, or t
  misc_feature (2120)..(2120): n is a, c, g, or t
cctgcctgcccccaaaatgtgaagcttgctgaaatcaacttgaaaggagatagcacatgccttttgtttctccgctctccccctatttctcttccttcctgctccctgcataatctgaattctctgaaggcaggggtcctgtcttactcatcttgatgttcatcgtgactcgtacagcagcggcggcagcggcagcccagccgagcgttaggtgctgctctctgcgcggcgttttgcaaaggacttcaccgatctacttttgcagtcgcctcggactgtccatgtgtttacttcccccagcccgaggattcgatatctaggttcctgtgaaatgcaactgagcagccaaagtactttgagaacacggggcggcataaacaccaaaacttttttgtggaaggaaaatgcaataagcaagcttgccgttttccgatgcggtgtggagtgagtgtgtgtcgcgcgtgtccgcactggaggcatatgcttgtgtgtgtacatggggtgtgtttttcggtatgtagggagaaaatgcttgccaaccaccggaaatctcctggaatttattagaaaataatggattataaaaagaaggcaagcaaggagcggatctccccttgagttgcaacccgatttgctgctggctcagtttgttgtgattctttttgttgataggtgtctgatggtattccgataacgttccccccttttcttccccttgagcttttacagtttaaaaaaaggaaacaaaaaccaccccaaaatctccccccccgtttttttcgccccgtcgggatcgccgtttccatccatgtgcttgcgtctcccccgcgttccacttaaactattttaatccttggacccaaggaggaggctgataggggggtggataaaaaaagttcttccaaaatagtgtgcccggggagcaggatgggggatttcgcagcccccgctgctgccgcgaatggcagtagtatttgcatcaacagtagcctgaacagcagcctcggcggggccgggatcggtgtgaataatactcccaatagtactcccgctgctccgagtagcaatcacccggcagccggtggatgcggcggctccgggggccccggcggcggttcggcggccgttcccaagcacagcaccgtggtggagcggctccgccagcgcatcgagggctgccgtcggcaccacgtcaactgcgagaacaggtaccagcaggctcaggtggagcagctggagctggagcgccgggacaccgtgagcctctaccagcggaccctggagcagagggccaagaaatcgggcgccggcaccggcaaacagcagcacccgagcaaaccccagcaagatgcggaggctgcctcggcggagcagaggaaccacacgctgatcatgctacaagagactgtgaaaaggaagttggaaggagctcgatcaccacttaatggagaccagcagaatggtgcttgtgatgggaatttttctccgactagcaaacgaattcgaaaggacatttctgcggggatggaagccatcaacaatttgcccagtaacatgccactgccttcagcttctcctcttcaccaacttgacctgaaaccttctttgcccttgcagaacagtggaactcacactcctgggcttctagaagatctaagtaagaatggtaggctccctgagattaaacttcctgtcaacggttgcagtgacctggaggatagcttcaccatcttgcagagcaaagacctcaaacaagaacctctcgatgaccctacttgcatagacacatcagaaacatctctttcaaatcagaacaagctgttctcagacattaatctgaatgatcaggagtggcaagaattaatagatgaattggccaacacggttcctgaggatgacatacaggacctgttcaacgaagactttgaagagaagaaggagccagaattctcgcagccagcaactgagacccctctctcccaggagagtgcgagcgtgaagagcgacccctctcactctcccttcgcacatgtctccatgggatctccccaggcgaggccttcttcttctggtcctcccttttctactgtctccacggccactagtttaccttctgntgncagcactcccgcagctccaaaccctgcaagctcaccagcaaactgtgctgtccagtcccctcaaactccaaaccaagcccacactccaggccaagctccacctcggcctggaaatggttatctcctgaatccggcagcagtgacagtggccggttcagcgtcagggcctgtggctgtgcccagctctgacatgtctccagcagaacagctcaaacagatggctgcacagcagcaacaaagggccaaactcatgcagcagaagcagcaacagcaacagcagcagcagcagcagcagcagcaacagcagcagcagcagcagcaacagcactcaaatcagacttcaaattggtctcccttaggacctccctctagtccatatggagcagcttttactgcagaaaaaccaaatagcccaatgatgtacccccaagcctttaacaaccaaaaccctatagtgcctccaatggcaaacaacctgcagaagacaacaatgaataactacctccctcagaatcacatgaatatgatcaatcagcagccaaataacttgggtacaaactccttaaacaaacagcacaatattctgacttatggcaacactaaacccctgacccacttcaatgcagacctgagtcagaggatgacaccaccagtggccaaccccaacaaaaaccccttgatgccgtatatccagcagcagcaacagcagcagcaacagcaacagcagcagcagcagcagcagcagccgccacctccacagctccaggcccccagggcacacctgagcgaagaccagaaacgcctgcttctcatgaagcagaaaggagtgatgaatcagcccatggcttacgctgcacttccatcccacggtcaggagcagcatccagttggacttccccgaaccacaggccccatgcagtcctccgtgcccccaggctcaggtggcatggtctcaggagccagtcccgcaggccccggcttcctgggcagccagccccaagcagccatcatgaagcagatgctcattgatcagcgggcccagttgatagagcagcagaagcaacagttcctgcgggagcaaagcgcagcagcagcagcagcagcagcagattttggcggaacaggtgacatgccccttggcgtgattcattcattcattcagcaagcacttattcagcacctgcctgctgcctgtgaggaagtggcagttcacatcctccatcaagatgctcacggtctagcatttcccaggatcacaagagaacctgaagaatttagacctttcaattagttagggtttttcctataatgaattaatttgttcttaaaagacaggctccagccatcaatttgaaggcctgtgtgccagagacatttctttgattcaagtctgactcctttccttctgatttctggtacaggggtctgtgtaatcagcacatggcggggactgtctcacatgctccataagccgtaatatttctagcttgaagaaaaaaataataattcagagaactctgtttcttagaggaaattgacaggaagaggaattgagaagaattctatagaatgggtaatgaacaatggatcaggaacaatagcagaataataaggcccgcagaactacctggaaacctgaactctgggtcacacacagggtgcaaacttaagaaaactccccacagcttttaaaacagctcaggacatctgtgagttcaaggaaagcctacacaaatacagtttaccttaagcattttgtccacctcgcctatattcctcgcttgag

SEQ ID NO: 280254 - DNA, 2489 bp, Homo sapiens
ggcaggaggagatggtcatgccaaggggactttttagtgaattttttcaggcaaaaaacccctactaccaccaccaaagctgagatgatccgtaacagaggacagaggatacaggcagttttcaaaaaaatattgatctggatcagatgggctgataaggcccaaacacttataaaccaaagctgcaggtctctaaggtcttcagagaagctacacaaaatactatgatttcattagcatccacatatgtatcattttccacaacattttacaattctcttgtttcacagggaaggtgaactaattataatgaaatatcagtaatgtatcttaaataagtaacatgttgctggaaaaaatttaagttaaaatgcactacataatagtgcagaaacaaagtgcaggtggcaattttaagacatgaaaacaatgctgaatcagtagtgtttggagtgatacattttgcccatttttggccagtcctagaacagtactcaccacaagctgcatgccaaatatgaactaatgaggctaaaacactgaagaccaaatagaaccactctagagtctgtttcacaatgagatactcctccccgttctggaaacagcgatctgctgtagttcctatcctcctgtggcacctatccctgctacagtacctataaccagatgtcctccatcatccagcctccaggacaagtggtgctcagtgagtcacaacctgaggaacagctgctggttaccgatttgtattcctgtatatactcgacttgggtagccaggattttctcgtttgtcttgaatatatttacttctaaaaagactgttagtcttgttgggaggtgagcagaggaatgtttacttgctggagaacatagtaacaaacatcacttctcacccctcataaacagaaagcccattgtctgtgccgtgaaaagaggactaccttgtcaggaagattttacttacctctacaagaaaaaggactcgtattaaaatcgacctgtggttaccacccttagaaatgctgttttcagatattcctattcctagtcttagaggcagccatggaatatatagtctcctctgaccttggggtcaggaagaaagggaaatctattcataaaaggaatttaaattctggcctaggcctctcaaacctgcttcaagtgaaagaagatagcttaactaacaggagcctcaagttgaatgtctttttttttttttttttttttttgagatggagtctccctgtgttgcccaggctggagtgcaatggcatgatcttggcttactgcagtctccacctctcgggctcaagcgattctccggcctcagcctcctgagtagctgggattacaggcatgcactaccccgcctagctaatttttgtatttttagtagagatggggtttcaccatgttggccaggctggtcttgaactcctgacctcaggtgatccgcccacctcagcctcccaatgtgctgagattacaggcgtgagccactgtgcctggcctgattcctttaatacaggctcaagcacaagtgcccacacgtatactgtgggtacaaccttcttttttttttttgagacggagtctcactctgtcgcccaggctggagtgcagtggcgcgatcttggctcactgcaagctccgcctcctgggttcacgccattctcctgcctcagcctcccgagtagctgggactacaggtgcctgccaccatgtccgactaatttttttgtatttttagtagagatggggtttcaccgtgttagacaggatggtctcgaactcctgaccttgtgatccgcccgcctcggcctcccaaagtgctgggattacaggtgtgagccaccgcgcccggcctggcagaaccttcttaacaagagggtccctccagcacatctttccgagagctaagttggtggggaaaacagactttgcactcatttggccgactgcctgagcagggtctgggaaaaatgcctttaaccccacctctgattccttgctcctatgctagaagactagcacatctatccctactgaacaaggagcttgtctggggttagggcactctcatcaaaaggcatctttgatgtttttgagctggcgcacagccagatctacagggaggctaaacttgaggctgctgaggcgactgagcaggttgagggcactctcaaagcctgtgtgtgccatgtagctccagggctggtagtgaggctcgatgagtgacccggacttgcagatgaggttcacccaggacaccagacgctgctcattcagtgccatgcacaccaaggccttcaattctgagtctgcactgcgcttaaaagggtcatgctctgtcagcaccatgtggatggctgtcagtaggctctgtttgggggtgacaacagtgcctcccgtaacaggaagggcgaaggactgggagagcttccgggctggggattccacataagcacggccgttcttagc

SEQ ID NO: 280255 - DNA, 1303 bp, Homo sapiens
ggcaggaggagatggtcatgccaaggggactttttagtgaattttttcaggcaaaaaacccctactaccaccaccaaagctgagatgatccgtaacagaggacagaggatacaggcagttttcaaaaaaatattgatctggatcagatgggctgataaggcccaaacacttataaaccaaagctgcaggtctctaaggtcttcagagaagctacacaaaatactatgatttcattagcatccacatatgtatcattttccacaacattttacaattctcttgtttcacagggaaggtgaactaattataatgaaatatcagtaatgtatcttaaataagtaacatgttgctggaaaaaatttaagttaaaatgcactacataatagtgcagaaacaaagtgcaggtggcaattttaagacatgaaaacaatgctgaatcagtagtgtttggagtgatacattttgcccatttttggccagtcctagaacagtactcaccacaagctgcatgccaaatatgaactaatgaggctaaaacactgaagaccaaatagaaccactctagagtctgtttcacaatgagatactcctccccgttctggaaacagcgatctgctgtagttcctatcctcctgtggcacctatccctgctacagtacctataaccagatgtcctccatcatccagcctccaggacaagtggtgctcagtgagtcacaacctgaggaacagctgctggttaccgatttgtattcctgtatatactcgacttgggtagccaggattttctcgtttgtcttgaatatatttacttctaaaaagactgttagtcttgttgggaggtgagcagaggaatgtttacttgctggagaacatagtaacaaacatcacttctcacccctcataaacagaaagcccattgtctgtgccgtgaaaagaggactaccttgtcaggaagattttacttacctctacaagaaaaaggactcgtattaaaatcgacctgtggttaccacccttagaaatgctgttttcagatattcctattcctagtcttagaggcagccatggaatatatagtctcctctgaccttggggtcaggaagaaagggaaatctattcataaaaggaatttaaattctggcctaggcctctcaaacctgcttcaagtgaaagaagatagcttaactaacaggagcctcaagttgaatgtctttttttttttttttttttggggccaaggcgattgggggttcccgagcaaaattccgtaaccttggccttagtttttcccggtgtaaaa

SEQ ID NO: 280256 - DNA, 539 bp, Homo sapiens
ccaggatcagcagtcttctgctgccttcttaatgtttcacctaagttcccatagttgctctcaaaaagtttcttggccctcgtgggccagtgtggaggggctgtatcatcattcatcaggagcgtcacttggtggtttagggggaaataatctattcttaagattgaagagagtgcaggatttggggggttgactctacatccttcagtatcagggcttatctccttgtcttacctcctaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280257 - DNA, 1148 bp, Homo sapiens
tcctaagtgaaatctccccttcactgtttcagagctgaggaacagataggtttctcctgccttcaggttctaggatccgctgtggtttatgcatgtgcacacgtgtgtgtgtgtgttacccccttgcctcatgtaggtcattaagattctgggcactgagaaggggaaaaagaacagaaccaacctgatatttctgtctgggaaccgggtgctgaagtggatggagagaagtcatggaactgaaaaagcactgactgctctgcttaaaagtatgcctgtttcagtaccttcgattacctcccatttctgagattttcgacataatctcttaccctggggtgtggagcagaggatcatgtggaagcagtgaaaaagctccagaactccaccaagatcctgcagaaggataggctctgcagacttggtcttctgcctaaacagatgtgtagtttgtcaaagtgggagtgaggggagaatgaggtggagggaagctgatactctctattgttatcctttccatttatctactgagttaccatatccatttcagaataacctgaatctgctcagagacctggctgtgcacattgcccatagcctcaggaacagtccagactggggaggtgtggtcatattacacaggtgagaaattaggagctggacacaaggaaggggaactgtgttgggcttagggctcagtgtcttctctatatgcaatgtacagtgggaggtggattgctcactggtattctcaagcagtactctctcttggctaagggatatgggactttatgtgtacataggcagcaaggccagcctcagaaggaggggccaggcttcctgcagtttcacagccaccactccaacctgggtctcatgtctgtgtcctttgttgtaggaaggagggtgattcagagttcatgaatatcattgccaatgagattgggtcagaggtaagaggagcatgagattctctaccccggcctggatagagacctagggagacataagtgaggggcgctagtttagccaaagtccctccacatgaacacatgaggaggaggaaatagccattcattcaatactgttttcttagtactagctatatgccaagctctgttttaggtgttgagctagatctatgttat

SEQ ID NO: 280258 - DNA, 896 bp, Homo sapiens
gtcagctcaccgcaacctccacctcttaaaaggcttttgatggcaaaatttgagtctcaatgcaggccctagaataacagccccagcaactgtacatccattaattcattaaatcctttggccaggcgtggtgctcatgcctagctaatttttttgtatttttagtagagatggggtttcaccgtgttagacaggatggtctcgaactcctgaccttgtgatccgcccgcctcggcctcccaaagtgctgggattacaggtgtgagccaccgcgcccggcctggcagaaccttcttaacaagagggtccctccagcacatctttccgagagctaagttggtggggaaaacagactttgcactcatttggccgactgcctgagcagggtctgggaaaaatgcctttaaccccacctctgattccttgctcctatgctagaagactagcacatctatccctactgaacaaggagcttgtctggggttagggcactctcatcaaaaggcatctttgatgtttttgagctggcgcacagccagatctacagggaggctaaacttgaggctgctgaggcgactgagcaggttgagggcactctcaaagcctgtgtgtgccatgtagctccagggctggtagtgaggctcgatgagtgacccggacttgcagatgaggttcacccaggacaccagacgctgctcattcagtgccatgcacaccaaggccttcaattctgagtctgcactgcgcttaaaagggtcatgctctgtcagcaccatgtggatggctgtcagtaggctctgtttgggggtgacaacagtgcctcccgtaacaggaagggcgaaggactgggagagcttccgggctggggattccacataagcacggccgttcttagc

SEQ ID NO: 280259 - DNA, 2182 bp, Homo sapiens
tgaagtacccaagtccccgagggcgcgccttccccgggaatttaattcaggacaataatgttttattgagcgcctattgtgaatcagacactgagcagtaagcgtcggagaaacagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggtgagtgtttccggctccggtgctccccctggcccttggcacgaggtggagattccctgctccaagtcttctgggcgctccaggttctgtgaggccccacgggagccccggacccctggtctctgtaactgtggggtgagggaaggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280260 - DNA, 1348 bp, Homo sapiens
ccaggcttctctgcgcgtgcgcctcctcacacgcctgcaggtatggcgttctggtgtcagcgtgacagttatgcccgagagttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280261 - DNA, 2037 bp, Homo sapiens
tgaagtacccaagtccccgagggcgcgccttccccgggaatttaattcaggacaataatgttttattgagcgcctattgtgaatcagacactgagcagtaagcgtcggagaaacagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280262 - DNA, 2092 bp, Homo sapiens
tgaagtacccaagtccccgagggcgcgccttccccgggaatttaattcaggacaataatgttttattgagcgcctattgtgaatcagacactgagcagtaagcgtcggagaaacagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggtgagtgtttccggctccggtgctccccctggcccttggcacgaggtggagattccctgctccaagtcttctgggcgctccaggttctgtgaggccccacgggagccccggacccctggtctctgtaactgtggggtgagggaaggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagcttttgaagaaggtcagcaccaagagacctccacctgccatggatgatttggatttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280263 - DNA, 1495 bp, Homo sapiens
ccaggcttctctgcgcgtgcgcctcctcacacgcctgcaggtatggcgttctggtgtcagcgtgacagttatgcccgagagttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaaaaaaaaagaaagacacaaaacaacaacagtgttggggcgcacctagggcccagaagagagaaggtgaagaaaaccacgtcagttgggacagcgggggcaccacaaggaaacggggaaacaggggcaccatagcgaggtacacaagggaaacaccggggaacagagaacgaagacggaggaacacacaaccaattaaaaggag

SEQ ID NO: 280264 - DNA, 1293 bp, Homo sapiens
ccaggcttctctgcgcgtgcgcctcctcacacgcctgcaggtatggcgttctggtgtcagcgtgacagttatgcccgagagttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280265 - DNA, 1673 bp, Homo sapiens
tgaagtacccaagtccccgagggcgcgccttccccgggaatttaattcaggacaataatgttttattgagcgcctattgtgaatcagacactgagcagtaagcgtcggagaaacagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280266 - DNA, 1981 bp, Homo sapiens
tgaagtacccaagtccccgagggcgcgccttccccgggaatttaattcaggacaataatgttttattgagcgcctattgtgaatcagacactgagcagtaagcgtcggagaaacagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280267 - DNA, 810 bp, Homo sapiens
cgctggagcgagaacagatgatagagcctggatgatctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280268 - DNA, 2124 bp, Homo sapiens
tgaagtacccaagtccccgagggcgcgccttccccgggaatttaattcaggacaataatgttttattgagcgcctattgtgaatcagacactgagcagtaagcgtcggagaaacagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaattgcctaagagacctcctcagaatatctcctggtccctgactgcagggaggcaccatagcaagaaggaaattattgatttatgtccccaacatcagaaacgactgggaagctgcgcaggtctcctctgacctttctctttcaggtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280269 - DNA, 1292 bp, Homo sapiens
ccaggcttctctgcgcgtgcgcctcctcacacgcctgcaggtatggcgttctggtgtcagcgtgacagttatgcccgagagttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaaaagtatgcctgtttcagtaccttcgattacctcccatttctgagattttcgacataatctcttaccctgggctgggattacaggtgtgagccaccatgcccagcctatgtgcaagtgttttcaagaaagattcctagaagtcatctactcttcttatccctctcccagtccctggaaaaagactcagagctgcccttgtttttttttgtgacttttccctcaaagtctccctgactatacctctgttccccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280270 - DNA, 1188 bp, Homo sapiens
aggaagattaaaacccctttaaaaggccatttaaaacctttatctctaacagtttcttaatgtataaaggttacacacttttatcaagacaaagcaaagttaacagcttcttaatgtataaaggatacatagttttatgtacacaaatcaaaggttctacatatgctagtgctccatacccaccttaaaaaaaaaaaaaaaaaaaaaagatcaagtgctttggatagtaaatcagaaccacgaaaagtggttaattcctttgtatgttttctcccagttgcctaagagacctcctcagaatatctcctggtccctgactgcagggaggcaccatagcaagaaggaaattattgatttatgtccccaacatcagaaacgactgggaagctgcgcaggtctcctctgacctttctctttcaggtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggtgagaaattaggagctggacacaaggaaggggaactgtgttgggcttagggctcagtgtcttctctatatgcaatgtacagtgggaggtggattgctcactggtattctcaagcagtactctctcttggctaagggatatgggactttatgtgtacataggcagcaaggccagcctcagaaggaggggccaggcttcctgcagtttcacagccaccactccaacctgggtctcatgtctgtgtcctttgttgtaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280271 - DNA, 428 bp, Homo sapiens
cggttgtgctggtcccagtctggtgaggaggcaaaggacgggtcttggtgagggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280272 - DNA, 1063 bp, Homo sapiens
gtgcagtggcacgatcttggctcactgcgacctccgcctcccaggctcaagcaattctcctgcctcagcctcccgagtagctgggactacaggtgcccgtcaccacgcccggataatttttgtatttttactagagacgaggtttcaccatattggccaggctggtctcgaactcctgaccttgtgatcctcctgcctcggccttccaaagtgctgagattacaggcatgagccaccacgcctggccggagggtaggacttctgagattttcagactctatcatgcctagctttgtgtgtagattggcaggttcctggtcaaaggagtgcagttgggaggactagggacctactgaccctcttttccccaggcgtgctcccatgcatatgcccacactctcccacacactcctgctcctgccctcctggcctgtgactcttggtgcctcttcttgcagccagtgtggctgtctgtggactttgataactggagagactgggaaggggatgaagagatggagctggctcatgtggaacattatgcagagcttttgaagaaggtcagcaccaagagacctccacctgccatggatgatttggatgatgattctgacagtgctgatgatgcaacaagtaattaactttctgtgacgcaaagctgggaaggcagctgtggctattttccagttgttctagaaagctagcgcctaggcctttgtcagcgctttggctgtgcaccaagttcttctgagatctctgaactttcctagaagctctttattaagggtcgtccttcaagcttgtcttcctcctaggcacttgactatggctccacatcagatgcagggtcggggaggggtagactggtagggcttctgatttcttactgattggtttctaatctctgtgtttaggccacttgattatttgagtatgtgtgtgtatgtggcaaaacaaaagccaaagaagaatgcagattatagaaatctctactatgtgtgcatatggggcaaagcaaaaagccaaagaagaaacagattataataaatctctaggaactgtt

SEQ ID NO: 280273 - DNA, 1841 bp, Homo sapiens
tgaagtacccaagtccccgagggcgcgccttccccgggaatttaattcaggacaataatgttttattgagcgcctattgtgaatcagacactgagcagtaagcgtcggagaaacagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatgatgattctgacagtgctgatgatgcaacaagtaattaactttctgtgacgcaaagctgggaaggcagctgtggctattttccagttgttctagaaagctagcgcctaggcctttgtcagcgctttggctgtgcaccaagttcttctgagatctctgaactttcctagaagctctttattaagggtcgtccttcaagcttgtcttcctcctaggcacttgactatggctccacatcagatgcagggtcggggaggggtagactggtagggcttctgatttcttactgattggtttctaatctctgtgtttaggccacttgattatttgagtatgtgtgtgtatgtggcaaaacaaaagccaaagaagaatgcagattatagaaatctctactatgtgtgcatatggggcaaagcaaaaagccaaagaagaaacagattataataaatctctaggaactgttctctgtctgtttccttcttgtacttattcctcctggtggcaagcctcttctccctctagtaaccaagctggggtgcttcctcttgcccagatttgtgctctgatttcttacagctaattctgtcatctctagaaccagccacttcagcttcctgcacactctagaaatctctttatacttttttttttttttttttccgagatggagtcttgctctgtcgcccaggctggagtgcagtggtgcagtctctgttcactgcaacctccaccttctgggttcaagcaattctcctgcctcagcctcccaagtagatgggactacagatgtgcaccaccaggcccagctaatttttgtatttttagcagagatggggtttcaccatgttggccaggctggtctcgaactcctgacctcaagtaatccacccacctcagcctcccaaagtgctaggattacatgtatgagccaccacacccggccctctttatacttttaaaactgattgttactctagttaatgtctatgtttatttgtccaacagctattctatttgtccataaacttttttgagtgcctaatatgtacagttgactgtaacttaaacaaaat

SEQ ID NO: 280274 - DNA, 1378 bp, Homo sapiens
tgaagtacccaagtccccgagggcgcgccttccccgggaatttaattcaggacaataatgttttattgagcgcctattgtgaatcagacactgagcagtaagcgtcggagaaacagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggttaaacagttgctgaacttaagggcatgacaaaaaggactcctctctctgacccaggtaggcaaaatgctttgggtgtgaggtaaaaaaaatgggtaagagcagctgtacagagtggggtgaaatgttaaacagggtgcagtgcccaagggctacgaaccaggtccagcgcaagcctgagaccacaggaggcacccacagctcacaaaggcgtctcgcctgattggccagggcaggatctgccgcctcttctcggt

SEQ ID NO: 280275 - DNA, 596 bp, Homo sapiens
  misc_feature (587)..(587): n is a, c, g, or t
  misc_feature (589)..(589): n is a, c, g, or t
  misc_feature (591)..(593): n is a, c, g, or t
tgaagtacccaagtccccgagggcgcgccttccccgggaatttaattcaggacaataatgttttattgagcgcctattgtgaatcagacactgagcagtaagcgtcggagaaacagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggtgagtgtttccggctccggtgctccccctggcccttggcacgaggtggagattccctgctccaagtcttctgggcgctccaggttctgtgaggccccacgggagccccggacccctggtctctgtaactgtggggtgagggaaggtgtgacctgaatgttctccctgacctcctagtttcctagtcttgcacgttctattcttcccaggttcacattcaccacacccacccactcctgtnantnnnttc

SEQ ID NO: 280276 - DNA, 268 bp, Homo sapiens
gtttacttatttccaccagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgcgcggatcatgctcgatcatgctcatcacgc

SEQ ID NO: 280277 - DNA, 1550 bp, Homo sapiens
ccaggcttctctgcgcgtgcgcctcctcacacgcctgcaggtatggcgttctggtgtcagcgtgacagttatgcccgagagttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaaaaaaaaaatacgtgaaacacgaatacaatgagtacgaatagatgaaaaatcacaaaaacaggataaccgaacaacaaaagaagaaaaacagaagagggggcgggtgggtaaaaaattaccccggggggcgcccgatgtgccacaccgcagttgttttaaaaaaagggccccgccatgggggtggacaataaaacaagagcgg

SEQ ID NO: 280278 - DNA, 1307 bp, Homo sapiens
ccaggcttctctgcgcgtgcgcctcctcacacgcctgcagttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280279 - DNA, 1491 bp, Homo sapiens
ccaggcttctctgcgcgtgcgcctcctcacacgcctgcaggtatggcgttctggtgtcagcgtgacagttatgcccgagagttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaattgcctaagagacctcctcagaatatctcctggtccctgactgcagggaggcaccatagcaagaaggaaattattgatttatgtccccaacatcagaaacgactgggaagctgcgcaggtctcctctgacctttctctttcaggtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280280 - DNA, 1198 bp, Homo sapiens
ccaggcttctctgcgcgtgcgcctcctcacacgcctgcaggtatggcgttctggtgtcagcgtgacagttatgcccgagagttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280281 - DNA, 1764 bp, Homo sapiens
ccaggcttctctgcgcgtgcgcctcctcacacgcctgcaggtatggcgttctggtgtcagcgtgacagttatgcccgagagttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggtgagaaattaggagctggacacaaggaaggggaactgtgttgggcttagggctcagtgtcttctctatatgcaatgtacagtgggaggtggattgctcactggtattctcaagcagtactctctcttggctaagggatatgggactttatgtgtacataggcagcaaggccagcctcagaaggaggggccaggcttcctgcagtttcacagccaccactccaacctgggtctcatgtctgtgtcctttgttgtaggaaggagggtgattcagagttcatgaatatcattgccaatgagattgggtcagaggtaagaggagcatgagattctctaccccggcctggatagagacctagggagacataagtgaggggcgctagtttagccaaagtccctccacatgaacacatgaggaggaggaaatagccattcattcaaagattcctagaagtcatctactcttcttatccctctcccagtccctggaaaaagactcagagctgcccttgtttttttttgtgacttttccctcaaagtctccctgactatacctctgttccccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280282 - DNA, 969 bp, Homo sapiens
  misc_feature (4)..(4): n is a, c, g, or t
gganaccctttccctgatcgctccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280283 - DNA, 1114 bp, Homo sapiens
ccaggcttctctgcgcgtgcgcctcctcacacgcctgcaggtatggcgttctggtgtcagcgtgacagttatgcccgagagttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaatgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 280284 - DNA, 1500 bp, Homo sapiens
tgaagtacccaagtccccgagggcgcgccttccccgggaatttaattcaggacaataatgttttattgagcgcctattgtgaatcagacactgagcagtaagcgtcggagaaacagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggttgttggagcagaaggatcatgtgggaagccgtgaaaagctccagaaatccacaagattctggaggaagaataacctgaatctgctcagagaccttggtgtgcatttgccatagctcagggaacagtccgatgggagggggggccaataccagggaccccctgtttttatgggggaagaagggggggccctttgggggcccgttttgtaccccgcactgttg

SEQ ID NO: 280285 - DNA, 1231 bp, Homo sapiens
tgaagtacccaagtccccgagggcgcgccttccccgggaatttaattcaggacaataatgttttattgagcgcctattgtgaatcagacactgagcagtaagcgtcggagaaacagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatgatgattctgacagtgctgatgatgcaacaagtaattaactttctgtgacgcaaagctgggaaggcagctgtggctattttccagttgttctagaaagctagcgcctaggcctttgtcagcgctttggctgtgcaccaagttcttctgagatctctgaactttcctagaagctctttattaagggtcgtccttcaagcttgtcttcctcctaggcacttgactatggctccacatcagatgcagggtcggggaggggtagactggtagggcttctgatttcttactgattggtttctaatctctgtgtttaggccacttgattatttgagtatgtgtgtgtatgtggcaaaacaaaagccaaagaagaatgcagattatagaaatctctactatgtgtgcatatggggcaaagcaaaaagccaaagaagaaacagattataataaatctctaggaactgtt

SEQ ID NO: 280286 - DNA, 1222 bp, Homo sapiens
tgaagtacccaagtccccgagggcgcgccttccccgggaatttaattcaggacaataatgttttattgagcgcctattgtgaatcagacactgagcagtaagcgtcggagaaacagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcaggtaaaggctgggatgggggacataacaccggagcagttgccatgtatggggatgctgtgatgactgagacgtagttgggttctctaggagttaaccttttggaaaagacagactattcagaatcagctgtaattcaggaaggatatcctaaatgttataa

SEQ ID NO: 280287 - DNA, 1904 bp, Homo sapiens
caatatgctcctagtaggtgctggtgaatctggaggtagctacgggatcagggaccagcagtgaaaagtgtacaaactgtatgtgtgtttggattctgccctgtcaactacctgcatgtggcctcaggtaccatcatccaaaaacattgtggctacatgtagatcatgtgcacgtgtttacgaaaccattccccatagccatagccacaggcctcagtcgattgggccagaaggtgcccccactattggcggagaacttagcttcagaattcaccctaaggttcccttagtccccatccccaccacacccccaggtcttgccagagccacctctccccacatgaccccccaagaaagacagccctgtattctaactcaacctgcagcatgccccgcactgccttataagacagttgaggagcggacatcagaaccacctctgaagccctttgttcttttttttctaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtacaaaaaaaactg

SEQ ID NO: 280288 - DNA, 876 bp, Homo sapiens
ctgacactgagcttggggcatcacaggtgctccatgtccaccagtggagtaaatgaactatttctaggcagctcagagcaagaaagttcttactggcacagggaatgcaaaggaggtgcacactggtgaggtacccatgaccccaacttcacaggcatttctattctgctcccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccaggtaaatgtgctccttgccagcttcactccttgcctctagagcagacaccctcttgcagtttgggacatacttgattcctgcagcctacgtgaactgaggcctactgccctgttccgttatggactgagggtagatttgggagtgagccttcttttccttcttctgttaaagtcactttgaaaccccaagttgtattggcttccttctgtgttttataaatgtccacctcagtcccttgctctcgtgcttaaagatatcactcggctgaaatgttcacctttgatgctgacttagggttggaggcagatatggccatcccagagacccactggcagctgaatgtcccaacactcaacgtccatggtccccgccatctactctggttttaaccattacccacatgagcagccactgctgttcactgtcccttgccccaggtgccccctgctcctccaggcgccccctgctcctccaggcccccactgctcctccaggtctccctg

SEQ ID NO: 280289 - DNA, 4015 bp, Homo sapiens
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacgcactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtacaaaaaaaactg

SEQ ID NO: 280290 - DNA, 3807 bp, Homo sapiens
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacgcactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgttactgttaaaa

SEQ ID NO: 280291 - DNA, 3192 bp, Homo sapiens
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacgcactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagaagactacccggtgggctcatagaccaccatagcggtccgaccccatatagcacttggctggaccatcaatcgctcattgatacggtacatttatttagttattgggaaa

SEQ ID NO: 280292 - DNA, 4094 bp, Homo sapiens
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgaaggtcagtccgttctccacagttgccctggaggcagggaccaagtcccacagagaagactctgccgaggctactgcagtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacgcactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtacaaaaaaaactg

SEQ ID NO: 280293 - DNA, 3877 bp, Homo sapiens
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacgcactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtacaaaaaaaactg

SEQ ID NO: 280294 - DNA, 3357 bp, Homo sapiens
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgaaggtcagtccgttctccacagttgccctggaggcagggaccaagtcccacagagaagactctgccgaggctactgcagtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacgcactcgacgtgggtgcctcgggccttaataccagtcattcgccatcggcgtcctcaagaagttcccacaaatcctcgcacacagccatgtcagaacccacctctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtacaaaaaaaactg

SEQ ID NO: 280295 - DNA, 2275 bp, Homo sapiens
ctgacactgagcttggggcatcacaggtgctccatgtccaccagtggagtaaatgaactatttctaggcagctcagagcaagaaagttcttactggcacagggaatgcaaaggaggtgcacactggtgaggtacccatgaccccaacttcacaggcatttctattctgctcccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtacaaaaaaaactg

SEQ ID NO: 280296 - DNA, 1179 bp, Homo sapiens
cccagaagtgattttggatgggaaatgagcaacagacaagtttgcatgcacctgttgcagacaagatgcaggctatgaatacagagagcgcttcggcccactcactgcccttaggggcttggggtggggtgcagagaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtacaaaaaaaactg

SEQ ID NO: 280297 - DNA, 2616 bp, Homo sapiens
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacgcactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccaggtaaatgtgctccttgccagcttcactccttgcctctagagcagacaccctcttgcagtttgggacatacttgattcctgcagcctacgtgaactgaggcctactgccctgttccgttatggactgagggtagatttgggagtgagccttcttttccttcttctgttaaagtcactttgaaaccccaagttgtattggcttccttctgtgttttataaatgtccacctcagtcccttgctctcgtgcttaaagatatcactcggctgaaatgttcacctttgatgctgacttagggttggaggcagatatggccatcccagagacccactggcagctgaatgtcccaacactcaacgtccatggtccccgccatctactctggttttaaccattacccacatgagcagccactgctgttcactgtcccttgccccaggtgccccctgctcctccaggcgccccctgctcctccaggcccccactgctcctccaggtctccctg

SEQ ID NO: 280298 - DNA, 1173 bp, Homo sapiens
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactagagtggccggtaccgagctcgatcgta

SEQ ID NO: 280299 - DNA, 173 bp, Homo sapiens
ataactctttcatctgattatgtttttcggctccaccttgaagttttcggcacagttcagcatgttccagaccatcaaagaccagctagagcagcggacgcggatcctgcaggccaatatccggtggcaacaggaagagctccacaagatccaggagcagctctgcctggtcc

SEQ ID NO: 280300 - DNA, 540 bp, Homo sapiens
actgtttgatgtgtgtgtttcaggacaagggctcaagcctggaacctcggcagcactttaacgcactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccaggcacatctgctcactgcctccacctacg

SEQ ID NO: 280301 - DNA, 3962 bp, Homo sapiens
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacgcactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaacaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtacaaaaaaaactg

SEQ ID NO: 280302 - DNA, 3619 bp, Homo sapiens
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacgcactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtacaaaaaaaactg

SEQ ID NO: 280303 - DNA, 3706 bp, Homo sapiens
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacgcactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtacaaaaaaaactg

SEQ ID NO: 280304 - DNA, 4150 bp, Homo sapiens
  misc_feature (1651)..(1651): n is a, c, g, or t
  misc_feature (1664)..(1664): n is a, c, g, or t
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgaaggtcagtccgttctccacagttgccctggaggcagggaccaagtcccacagagaagactctgccgaggctactgcagtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacgcactcgacgtgggtgcctcgggccttaataccagtcattcgccatcggcgtcctcaagaagttcccacaaatcctcgcacacagccatgtcagaacccacctgccnccccaattttggnttttccaaagggaaaaaaaacccccccaaacctccaaacccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtacaaaaaaaactg

SEQ ID NO: 280305 - DNA, 1973 bp, Homo sapiens
gggaggtttcctggagagatggcccagggttgagtccaagtcttacctttctcattgaaatgatgctccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtacaaaaaaaactg

SEQ ID NO: 280306 - DNA, 2074 bp, Homo sapiens
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggagagccatttcagagactgtgaagaatccaggtgccatgtcttagtggccaggatgttccctttctaaaatgaggacagagcccaggagataacccatcatgtccctagggaactgctaatgccctccagatgtgactcccgtcttcttccctcttctctctaagaggcacaaaaccagactccaggaggactcacatagctgtgaagtttgaaaaaacaaaattgacctggctgaaaaaacaaaattgacctggctgcagaccagccaagctggtaaaagtatcagctggcaaagactgtggctaccagcattggagcagttgcactcaaaaggagccaaagtgcctgtggcctgcggaatagggagcttgtggaatttctgaattttaatcagaaaagcaatctcttctcttagcccagaggttgtcccaaggaacacaagaaatgttccatctgattcaggaatttgcagaaagggaaggtttcgtttccctctaatgtgtggcggttagaaaattctgggccattatggcacctttggaaacaccccagtcaaaatcaccattccatggataggggcacagcactttgcaatcacttgctgttgaatccctttcagatgctactgatgggacttccagaaccacagccagctttcttaaagcaatgactcagtgcagttctcatagagttgatggaaatgccaatgagctgatgaaagttatctcccgtctataaataccttcagctttttaacacccgcttgctttagacactcaggagggacatgggctcactgtgcaagacgatttgcactgcccttgcttttcccagctttccaatctgctttttccagaaaagtctcactgatgtcatcaacagtgcccttaccccttaaaaaaattcacctcctagagggcttcatagatgactttaaaacatttttagaaaaatacctgggaaggaaaagttactgggatgtacttcttcgtttactgtaactcaaatctaacccagcatttctcaatcttgcactatggtcattttggacctggtagttcttcgtcgtggggactctcctgcatattacaggatgtttggcagcactagatgccaaagtcacccactccagtggtgacaatcaaaaatgcctccagacattaccaaaattgcccccagttgagaaccactgatgtcatccaagaggacgaggtccatttaagaaacgtacttgaatctgtttttcagtctaaatcctaccagctgtcggtgtaaaataataaatgagtctagtgttaattttcctggtgaaaagaactctttcccctttcggcatggtataaaggtgcccttcatgcactgctcgtggcctcttccgggttcccgctgccatgcacttcagccacaccctcctaatgtgaaagaatgaattgtccacacagattctcagacatcacgtgaccatctagttgagtgcatgcaacatgtttccagagctttctaagcacatatttca

SEQ ID NO: 280307 - DNA, 1177 bp, Homo sapiens
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagcctaagccgggaaccgcgcagcgggagctcgtgtgagctgaccgcagcagcagc

SEQ ID NO: 280308 - DNA, 191 bp, Homo sapiens
taaattggtgagaactaatggttctttattttcttagtattaatagccttttatcataaatggcaagattcgaaatcagctcattactactaattggttatatatttttctgaaaagtaccctgggtttcatcctgttgtttagagagtttccacgaagggaatatattaagacttgctgcacactgtcgg

SEQ ID NO: 280309 - DNA, 213 bp, Homo sapiens
taaattggtgagaactaatggttctttattttcttagtattaatagccttttatcataaatggcaagattcgaaatcagctcattactactaattggttatatatttttctgaaaagtaccctgggtttaactgtaaacttgtttgttttgcacaaaactacaaattagttttctgaagttattatctgtgaatatatatatatatatattta

SEQ ID NO: 280310 - DNA, 521 bp, Homo sapiens
cctcatccgcaaaatgagacatggggtgagattaacactacgctcttcccttaacaacctcaggctctctgatactgtccactgcaacacagatctcaaacaccggtttaccccacacccaaatatggtggttacttctagactttgaccattttgcttgcctagttctcagctctccggtaagaaaagacagccatgcctgacttctgttgtgaaagggaacacagagggcatcgtcatggggattccgaaaatgggtccagttttggccagggggacccctggagcttgcccattggacttggagctaaaagcatcttagcaactaagacagccggtctttatagcctggatgaaatttgtatctatttcccagatggacaagagcctagaagatcccagccttgccactgggtatgagcacaggacagggggacgctcaatgctaaggctgccagagaaaatacaggacttccggttaaatttgaatttcaaataaacaagtaatttttaaagtataa

SEQ ID NO: 280311 - DNA, 448 bp, Homo sapiens
tctcccttctcttccccctccagcctccactccttcgcccgctcactcaccctctccctctcccgctgccccccctttctcccccacctctttgtttcagctgagaaccagctcctcgggacagttcccacactgcagtgcctctggtgaggagacagcgccactgaggcctcctctgaactcccaaaatgtgacctatgccatcaccgaggccgcaggaacaagaggtgggtgtccatgacattggtacctgtcatccctgtgtgcagcaggtgtgccccaccctggaggcagcagaagaagatggacaagagcctagaagatcccagccttgccactgggtatgagcacaggacagggggacgctcaatgctaaggctgccagagaaaatacaggacttccggttaaatttgaatttcaaataaacaagtaatttttaaagtataa

SEQ ID NO: 280312 - DNA, 380 bp, Homo sapiens
aattgtgtgaagaatgatgttggtagtttgataggaatacagttgaatctgtaggttgctttgagcagtgtggccattttaacaatactgattattccaattcatgagcatggaatgtttttccatttatctgtgtcatctgtgatttctctcagcagtgttctgtagtttttcttgtagagatctttcacctccttggttagatgtattcctaggtatttagtgtgtgtgtgtggctattgtaagtgagattgcgttcttgatttggctctcagtttaaatgttattggaaaacatgttccttaaaaggacatttcactttgggggaatatagaaggggggcttttcctgtgggcatttgctcactgactcatttctgt

SEQ ID NO: 280313 - DNA, 651 bp, Homo sapiens
ggtcgctctaggaaagcggcggaggaccctctatggtcccgggcccacccgaaagcgttgttcgtttcttcctgtggttttgttttctcctccccccaactcggaaggcgtcctgtgacccccgggacctcaagagctgtaaccgcccctgtgtgtggtcgaggcttttgaaaccaaactctagcctctccaacctagaaactgcatactttccacaaaatttgagatttttgagaccctggtacttttcacgaagtcaccttaattatcaccaaaaagctcctgcaagatgggagtggttatactccatttacaggaaaggaaccaaggctcagagaagaaatgtgctccgttcaccgtgtgctcctcctcagccatcctggccgtgctcagtcatctgaccagctgacctccgtgttcccccactccctggggagctcctccgccttttggcttccaatgctattgctgcatgctgaagactcccgcattgggagctgtctctgcatatggcaaagcacaaagctgaatgaggtctggacaaagaagctccactcgcaatctagagagtatctggactattgcagtgattaaatgaggggaagtattgaaagtcattgaaagtcatccccacccactagaggagagaaa

SEQ ID NO: 280314 - DNA, 1564 bp, Homo sapiens
aaaggttgctcaatcgcagatggaccaatggtgaaagcacacctgaacaaaggaaaagcagacatatttatcccttacacatttgggttgtccttactgctgtgtcctgcatccattggctggagcggaacctcacactcttaaactgatacccaatttgctaatagcctaaaacttcctaaataggtttgagacttaaatacctctctactaaaagggaaatggataaaaaggctcctcctcagccatcctggccgtgctcagtcatctgaccagctgacctccgtgttcccccactccctggggagctcctccgccttttggcttccaatgctattgctgcatgctgaagactcccgcattggtaactccagtctgactgtgggacataaatgttattgaactttagacttgtatatcgaactgattactcaagagctgcatttgcatgtgtaatggacatcccaaacctaacataccccccaaatgaattcctgatatctacctaacctgttcttgcaacagtcttcttcccagggatgggtgaagatcccatcatctttccagttgctcaagccaaaaaccttgatgtcactgttgtctcttctttttttcatccaaaattcacctgtgatttatccacaaattctgtcggcttcatcgttaaaatatattcattatcaagccactttcaacacttccactgctataaccaccaagccaccttcatccaccttctggattattatattggcttccagacgggttgccctacagtctattcacggccccagagtaatcctcttaaacctaagttagatcatgtcattcatttgttcaaaaccttcaaaggcttcccaacttattagagcaaagccaaggacctcgcagtggcacccgatgcctctcatgatctgtctctttagttctttattgtgtctgcagtgctgaaaacagtgctcagcagggaacagacactcagtaaatagctgttgaatgaatgaatttataagatgccttattgtttacaaagtacttttacatcttatcttctggttattcatcttcaccatagtctcatgaagcacagattatcatatctgtcttgcaaatcagtaaactgaagcaagagaggctgacctgcctgaagtaatacagtggtttgttggtggaggctaaactaagtcataggttcattctcttaagttggggctttctgctctgtagggagctgtctctgcatatggcaaagcacaaagctgaatgaggtctggacaaagaagctccactcgcaatctagagagtatctggactattgcagtgattaaatgaggtaatgtaaggcacttagcacaatgtataacacagaagaaatgagagtcgttgttacttttattattaaattgttataagttggttgatgctggtggttggagagtttggggtaaagggcaatggccagagatctagaaatggtttaggaaaagcgtcaggagcaaacatgacccgttgggactgtctgctctatgtacactaaaataaaaagataatttttaaaaagcca

SEQ ID NO: 280315 - DNA, 1693 bp, Homo sapiens
ggtcgctctaggaaagcggcggaggaccctctatggtcccgggcccacccgaaagcgttgttcgtttcttcctgtggttttgttttctcctccccccaactcggaaggcgtcctgtgacccccgggacctcaagagctgtaaccgcccctgtgtgtggtcgaggcttttgaaaccaaactctagcctctccaacctagaaactgcatactttccacaaaatttgagatttttgagaccctggtacttttcacgaagtcaccttaattatcaccaaaaagctcctgcaagatgggagtggttatactccatttacaggaaaggaaccaaggctcagagaagaaatgtgctccgttcaccgtgtgctcctcctcagccatcctggccgtgctcagtcatctgaccagctgacctccgtgttcccccactccctggggagctcctccgccttttggcttccaatgctattgctgcatgctgaagactcccgcattggtaactccagtctgactgtgggacataaatgttattgaactttagacttgtatatcgaactgattactcaagagctgcatttgcatgtgtaatggacatcccaaacctaacataccccccaaatgaattcctgatatctacctaacctgttcttgcaacagtcttcttcccagggatgggtgaagatcccatcatctttccagttgctcaagccaaaaaccttgatgtcactgttgtctcttctttttttcatccaaaattcacctgtgatttatccacaaattctgtcggcttcatcgttaaaatatattcattatcaagccactttcaacacttccactgctataaccaccaagccaccttcatccaccttctggattattatattggcttccagacgggttgccctacagtctattcacggccccagagtaatcctcttaaacctaagttagatcatgtcattcatttgttcaaaaccttcaaaggcttcccaacttattagagcaaagccaaggacctcgcagtggcacccgatgcctctcatgatctgtctctttagttctttattgtgtctgcagtgctgaaaacagtgctcagcagggaacagacactcagtaaatagctgttgaatgaatgaatttataagatgccttattgtttacaaagtacttttacatcttatcttctggttattcatcttcaccatagtctcatgaagcacagattatcatatctgtcttgcaaatcagtaaactgaagcaagagaggctgacctgcctgaagtaatacagtggtttgttggtggaggctaaactaagtcataggttcattctcttaagttggggctttctgctctgtagggagctgtctctgcatatggcaaagcacaaagctgaatgaggtctggacaaagaagctccactcgcaatctagagagtatctggactattgcagtgattaaatgaggtaatgtaaggcacttagcacaatgtataacacagaagaaatgagagtcgttgttacttttattattaaattgttataagttggttgatgctggtggttggagagtttggggtaaagggcaatggccagagatctagaaatggtttaggaaaagcgtcaggagcaaacatgacccgttgggactgtctgctctatgtacactaaaataaaaagataatttttaaaaagcca

SEQ ID NO: 280316 - DNA, 466 bp, Homo sapiens
atcttggctcactgcaacttctgcctcccaggttcaagcgattctcctgcctcagcctccttagttaggattacaggtgcccgccactgtgcccgactaatttttgtatttttagtagagacagggtttcgccatgttggccaggcttgtctcaaactcctgacctcaggtgatccgcccgcctcggcctcccaaagtgctgggattacagatgtgagccactgcacccggcctgatcattttttaataacattgttctcctcctcctcctttaagagacagggtctcactgtgctgcccaggctggcctcaaactcctgggctcaagcagtcctccccactcagactcctgagtagctgggactacaaacacaccaccacgctcagctaactccccatctcttaatccctatccctacaccattcccaaactttcccaaatcaaagattaaccagacagagaaaa

SEQ ID NO: 280317 - DNA, 901 bp, Homo sapiens
gtgccagtccctggacagctacgacgccatgaatatcttgcccaagaagagctggcacgtccggaacaaggacaatgtcgcccgcgtgcggcgtgacgaggcccaggcccgggaggaggagaaggagcgtgagcggagggtgctgctggctcagcaagaggcccgtacagaattcctacggaagaaagccagacatcagaactcactgcctgagcttgaagcagcagaggcgggagccccaggttctggccctgtggacctgtttcgggagctgctggaggaagggaaaggagtgatcagaggcaataaagagtacgaggaagaaaagcgacaggagaaagagaggcaagagaaagctctgggcatcctgacatacctgggccagagtgcagcggaggcacagactcaacccccttggtaccagctacccccagggcgagggggccccccgcccggcccagccccagatgagaagatcaagagccgtctggaccctctgcgggagatgcagaagcatctggggaagaagagacagcacggcggtgatgaaggcagtcgcagcagaaaggaaaaggaggggtctgagaagcagcgacccaaggagcctccatccctggaccagcttcgagctgaacgtctgcggagggaagcagctgagaggtctcgggcagaggccctgctggcccgggtccaaggccgggcactacaggagggtcagccggaagaagacgagacggatgaccggcggcggcggtacaactcccaattcaacccccagctggcccggcgcccccgccagcaggaccctcaccttactcactgactcctgagggggtacaggagaggccgctgctgccagccgtcatataaaactatttattcataaatattttccaaaatg

SEQ ID NO: 280318 - DNA, 1040 bp, Homo sapiens
attatctgacacctgtccgtcccaccttggatagtacaaaagtgacaagaggatgctaaaagttttaaaggggctgttggaaaatacgagctgggaaacatgtagagctaaatatgagctcaggtcaatattaaaattggaagtaggtcacagaatcccaaccccacatatttggatccagcccttggtgagtgggccttggactgtacttcacaatcccatcttcacctgcagttgtccggccaacatggccccttcccgcctgccctttcctaaccacctccactctctctagtgaagacgctgagctcgcagccatgctggttgcacactgccattttctacaggttctcaagtgcatgggctgccaagagggttgggtgtttacatttatttttaatagaaatggggtcgtacccggggcatctcttttcttcatactgcaatgttgctagatacacaatcagacaccagagggttgggcattcttgcaataccttaacagtgctgaaacctgcagcatggtactaaggaagttaaagttagaatgtaaccactttatttaaaaggtttttttctttaatttaaatgaaatggggttgaagtgaacatgatcttgttgaccatgttcgtgaattatagatgcaacatgcattggtagaatcgtgtgatggtcttttgtgatacttaatttttacatatcccagtctctgtatgtatctgcacaaagaaaaaacaaactcctgctttgctcttattgaagggttcccaggactgcgtgtctgctcctgagctctgttttaagtatgtgtatcctttgcttgtattttgtattaaaaaagtaagaaaaagaaccctttattgttgagcatgttggcattgtcccgtttatttttttctctttttgggacatatgaagcaagttattctttttctgtatctttttttcttttgtaaactttttgtttttttcttgtttaaaattggctttataaaagggcttttataacccaccccccccccaaaaaaaagaaatgggg

SEQ ID NO: 280319 - DNA, 3128 bp, Homo sapiens
  misc_feature (3125)..(3128): n is a, c, g, or t
cagataccgtcctcacaatacctgcccagaaagacgagaaagaggaggaagaattcctccttccaccaggaattctgtgggaagcacataagatttcatgctactagtttattcccaagagaagctaccaaagcctggtaactctaccaactctaacttttgtgcctgtaagttctcttctcctgggattacaactaattgaaacaggaattcaaaggagtctcggaggactgtaagaagaatgcttcgaggccgatccctctctgtaacatccctgggtgggcttccccagtgggaagtcgaagaacttcctgtggaggagttactgctctttgaagttgcttgggaagtgaccaataaagttggaggcatctatactgtgattcagacaaaggccaaaacaacagcagatgaatggggagagaactattttctgataggtccatattttgagcataatatgaagactcaggtggaacagtgtgaacctgtaaatgatgctgtcagaagagcagtggacgcaatgaataagcatggctgccaggtgcattttggaagatggctgatagaaggaagtccttatgtggtactttttgacataggctattcagcttggaatctggacaggtggaagggtgacctctgggaagcatgcagtgtcggcattccttatcatgaccgagaagccaatgatatgctgatatttggatctttaactgcctggttcttaaaagaggtgacagatcatgcagatggtaaatatgtcgttgcccaattccatgaatggcaggctggaattggactgatcctttctcgagccaggaaacttcctattgccacaatatttacaacccacgctacactacttgggaggtatctctgtgcagcaaatattgatttctacaaccatcttgataagtttaacattgacaaagaggctggggaaaggcagatttaccaccggtactgcatggagcgagcttccgttcattgcgctcacgtgttcaccacggtttctgaaataacagcaatagaagctgaacatatgctgaagagaaagcctgatgtagttactccaaacggcttgaatgttaagaaattttcagcagtgcatgagtttcaaaatctacatgccatgtacaaggccagaatccaagattttgttcgaggtcatttctatggtcatctcgactttgatcttgaaaagactttgttccttttcattgctgggaggtatgagttttcaaacaaaggagctgacatcttcctagaatccttatccaggctaaatttcctgctgaggatgcataaaagtgacatcacagtgatggtgtttttcattatgcctgccaagacaaataatttcaacgtggaaaccctgaaaggacaagcagtgcgaaaacagctgtgggatgttgcacattctgtgaaggaaaagtttggaaaaaaactctatgatgcattattaagaggagaaattcctgacctgaacgatattttagatcgagatgatctaacaattatgaaaagagccatcttttcaactcagcgacagtcattgcccccagtgaccacgcacaacatgattgatgactccaccgaccccatcctcagcaccattagacggattggacttttcaacaaccgcacagatagagtcaaggtgattttgcacccagagtttctatcctccaccagtcccttactacccatggactatgaagagtttgttagaggttgtcatcttggagtatttccatcatactatgaaccctggggttatactccagctgaatgcactgtgatgggtatccccagtgtgaccacgaatctctccgggtttggctgtttcatgcaggagcacgtggctgatcctactgcttacggtatttacatcgttgacaggcggttccgttctccagatgattcttgcaatcagctgactaagtttctctatggattttgcaaacagtcacgccgccaaaggattatccagaggaacagaactgagaggctctcagatcttctggattggagatacttaggcagatattaccagcatgccagacacctgacattaagcagagcttttccagataaattccatgtggaactaacatcaccaccaacgacagaaggatttaaatatcccaggccttcctcagtaccaccttctccttcagggtctcaggcctccagtcctcagagcagtgatgtggaagatgaagtggaggatgagagatacgatgaggaagaggaggctgaaagggatcggttaaatatcaagtcaccattttcactgagccacgttcctcatgggaagaaaaagctgcatggtgaatataagaactgaattctacatgtgctgcatgaagagctaatttaaaaaagcaaagtaagactaattatttaaaataaaaatgccacaaatttcattttctccttctaagtattacaatggagtttattctctgcctaaaaagtggaagaaattgagtgaatgataattttgtaatttaggataagatccaagttattttccccaactcttgtttcccccataaagttaggcatgaggaggagcactcattaaaggcagaagacggaaaagtgtttttaaaatggtgaatttaagtggtaagtattttctcttactctgtttatttttaaatgatcatcataatcctttgcttactatttatgcagcttctctaccccaccacacaaatttcccatttcccccccgaaaaccttgatcttacccatgaatgtgcactacctacattttttaaatagctaggtttttactgattattttcatttttcacatgcatcagaaccatgatttagatgtagttttgcagagacaaaaatccatgagtgaatagctatcctaagtccatattttgatgcatattaatggacatttatgtcacttttgaaatctagaattgatgttgtaattaatgcaagatattaccatgtacatggtaccaccatcttactgtaacatttttctattgtttaaatagaaagcctttttaaaatttggtcaatcttcatagatgataacttgtaaaatccaagtaaataaacacattaatatttaataacttaaaaaaaannnn

SEQ ID NO: 280320 - DNA, 624 bp, Homo sapiens
  misc_feature (621)..(624): n is a, c, g, or t
cccttctaagtataccagtaaggataagattattttccccaactcttgtttcccccataaagttaggcatgaggaggagcactcattaaaggcagaagacggaaaagtgtttttaaaatggtgaatttaagtggtaagtattttctcttactctgtttatttttaaatgatcatcataatcctttgcttactatttatgcagcttctctaccccaccacacaaatttcccatttcccccccgaaaaccttgatcttacccatgaatgtgcactacctacattttttaaatagctaggtttttactgattattttcatttttcacatgcatcagaaccatgatttagatgtagttttgcagagacaaaaatccatgagtgaatagctatcctaagtccatattttgatgcatattaatggacatttatgtcacttttgaaatctagaattgatgttgtaattaatgcaagatattaccatgtacatggtaccaccatcttactgtaacatttttctattgtttaaatagaaagcctttttaaaatttggtcaatcttcatagatgataacttgtaaaatccaagtaaataaacacattaatatttaataacttaaaaaaaannnn

SEQ ID NO: 280321 - DNA, 377 bp, Homo sapiens
  misc_feature (374)..(377): n is a, c, g, or t
accgcactatttatgcagcttctctaccccaccacacaaacccaaatagctaggtactgattattttcatttttcacatgcatcagaaccatgatttagatgtagttttgcagagacaaaaatccatgagtgaatagctatcctaagtccatattttgatgcatattaatggacatttatgtcacttttgaaatctagaattgatgttgtaattaatgcaagatattaccatgtacatggtaccaccatcttactgtaacatttttctattgtttaaatagaaagcctttttaaaatttggtcaatcttcatagatgataacttgtaaaatccaagtaaataaacacattaatatttaataacttaaaaaaaannnn

SEQ ID NO: 280322 - DNA, 3090 bp, Homo sapiens
  misc_feature (3087)..(3090): n is a, c, g, or t
cagataccgtcctcacaatacctgcccagaaagacgagaaagaggaggaagaattcctccttccaccaggaattctgtgggaagcacataagatttcatgctactagtttattcccaagagaagctaccaaagcctggtaactctaccaactctaacttttgtgcctgtaagttctcttctcctgggattacaactaattgaaacaggaattcaaaggagtctcggaggactgtaagaagaatgcttcgaggccgatccctctctgtaacatccctgggtgggcttccccagtgggaagtcgaagaacttcctgtggaggagttactgctctttgaagttgcttgggaagtgaccaataaagttggaggcatctatactgtgattcagacaaaggccaaaacaacagcagatgaatggggagagaactattttctgataggtccatattttgagcataatatgaagactcaggtggaacagtgtgaacctgtaaatgatgctgtcagaagagcagtggacgcaatgaataagcatggctgccaggtgcattttggaagatggctgatagaaggaagtccttatgtggtactttttgacataggctattcagcttggaatctggacaggtggaagggtgacctctgggaagcatgcagtgtcggcattccttatcatgaccgagaagccaatgatatgctgatatttggatctttaactgcctggttcttaaaagaggtgacagatcatgcagatggtaaatatgtcgttgcccaattccatgaatggcaggctggaattggactgatcctttctcgagccaggaaacttcctattgccacaatatttacaacccacgctacactacttgggaggtatctctgtgcagcaaatattgatttctacaaccatcttgataagtttaacattgacaaagaggctggggaaaggcagatttaccaccggtactgcatggagcgagcttccgttcattgcgctcacgtgttcaccacggtttctgaaataacagcaatagaagctgaacatatgctgaagagaaagcctgtcagcagtgcatgagtttcaaaatctacatgccatgtacaaggccagaatccaagattttgttcgaggtcatttctatggtcatctcgactttgatcttgaaaagactttgttccttttcattgctgggaggtatgagttttcaaacaaaggagctgacatcttcctagaatccttatccaggctaaatttcctgctgaggatgcataaaagtgacatcacagtgatggtgtttttcattatgcctgccaagacaaataatttcaacgtggaaaccctgaaaggacaagcagtgcgaaaacagctgtgggatgttgcacattctgtgaaggaaaagtttggaaaaaaactctatgatgcattattaagaggagaaattcctgacctgaacgatattttagatcgagatgatctaacaattatgaaaagagccatcttttcaactcagcgacagtcattgcccccagtgaccacgcacaacatgattgatgactccaccgaccccatcctcagcaccattagacggattggacttttcaacaaccgcacagatagagtcaaggtgattttgcacccagagtttctatcctccaccagtcccttactacccatggactatgaagagtttgttagaggttgtcatcttggagtatttccatcatactatgaaccctggggttatactccagctgaatgcactgtgatgggtatccccagtgtgaccacgaatctctccgggtttggctgtttcatgcaggagcacgtggctgatcctactgcttacggtatttacatcgttgacaggcggttccgttctccagatgattcttgcaatcagctgactaagtttctctatggattttgcaaacagtcacgccgccaaaggattatccagaggaacagaactgagaggctctcagatcttctggattggagatacttaggcagatattaccagcatgccagacacctgacattaagcagagcttttccagataaattccatgtggaactaacatcaccaccaacgacagaaggatttaaatatcccaggccttcctcagtaccaccttctccttcagggtctcaggcctccagtcctcagagcagtgatgtggaagatgaagtggaggatgagagatacgatgaggaagaggaggctgaaagggatcggttaaatatcaagtcaccattttcactgagccacgttcctcatgggaagaaaaagctgcatggtgaatataagaactgaattctacatgtgctgcatgaagagctaatttaaaaaagcaaagtaagactaattatttaaaataaaaatgccacaaatttcattttctccttctaagtattacaatggagtttattctctgcctaaaaagtggaagaaattgagtgaatgataattttgtaatttaggataagatccaagttattttccccaactcttgtttcccccataaagttaggcatgaggaggagcactcattaaaggcagaagacggaaaagtgtttttaaaatggtgaatttaagtggtaagtattttctcttactctgtttatttttaaatgatcatcataatcctttgcttactatttatgcagcttctctaccccaccacacaaatttcccatttcccccccgaaaaccttgatcttacccatgaatgtgcactacctacattttttaaatagctaggtttttactgattattttcatttttcacatgcatcagaaccatgatttagatgtagttttgcagagacaaaaatccatgagtgaatagctatcctaagtccatattttgatgcatattaatggacatttatgtcacttttgaaatctagaattgatgttgtaattaatgcaagatattaccatgtacatggtaccaccatcttactgtaacatttttctattgtttaaatagaaagcctttttaaaatttggtcaatcttcatagatgataacttgtaaaatccaagtaaataaacacattaatatttaataacttaaaaaaaannnn

SEQ ID NO: 280323 - DNA, 1420 bp, Homo sapiens
cagataccgtcctcacaatacctgcccagaaagacgagaaagaggaggaagaattcctccttccaccaggaattctgtgggaagcacataagatttcatgctactagtttattcccaagagaagctaccaaagcctggtaactctaccaactctaacttttgtgcctgtaagttctcttctcctgggattacaactaattgaaacaggaattcaaaggagtctcggaggactgtaagaagaatgcttcgaggccgatccctctctgtaacatccctgggtgggcttccccagtgggaagtcgaagaacttcctgtggaggagttactgctctttgaagttgcttgggaagtgaccaataaagttggaggcatctatactgtgattcagacaaaggccaaaacaacagcagatgaatggggagagaactattttctgataggtccatattttgagcataatatgaagactcaggtggaacagtgtgaacctgtaaatgatgctgtcagaagagcagtggacgcaatgaataagcatggctgccaggtgcattttggaagatggctgatagaaggaagtccttatgtggtactttttgacataggctattcagcttggaatctggacaggtggaagggtgacctctgggaagcatgcagtgtcggcattccttatcatgaccgagaagccaatgatatgctgatatttggatctttaactgcctggttcttaaaagaggtgacagatcatgcagatggtaaatatgtcgttgcccaattccatgaatggcaggctggaattggactgatcctttctcgagccaggaaacttcctattgccacaatatttacaacccacgctacactacttgggaggtatctctgtgcagcaaatattgatttctacaaccatcttgataagtttaacattgacaaagaggctggggaaaggcagatttaccaccggtactgcatggagcgagcttccgttcattgcgctcacgtgttcaccacggtttctgaaataacagcaatagaagctgaacatatgctgaagagaaagcctgatgtagttactccaaacggcttgaatgttaagaaattttcagcagtgcatgagtttcaaaatctacatgccatgtacaaggccagaatccaagattttgttcgaggtcatttctatggtcatctcgactttgatcttgaaaagactttgttccttttcattgctgggaggtatgagttttcaaacaaaggagctgacatcttcctagaatccttatccaggctaaatttcctgctgagggtaagaaagctctaggacatggtataacactcttgtagggagaactttcttctgtgggaagtgaagaattttttggcttcttaaatagttttcaagagaataaacgataatcgtatt

SEQ ID NO: 280324 - DNA, 3074 bp, Homo sapiens
  misc_feature (3071)..(3074): n is a, c, g, or t
cagataccgtcctcacaatacctgcccagaaagacgagaaagaggaggaagaattcctccttccaccaggaattctgtgggaagcacataagatttcatgctactagtttattcccaagagaagctaccaaagcctggtaactctaccaactctaacttttgtgcctgtaagttctcttctcctgggattacaactaattgaaacaggaattcaaaggagtctcggaggactgtaagaagaatgcttcgaggccgatccctctctgtaacatccctgggtgggcttccccagtgggaagtcgaagaacttcctgtggaggagttactgctctttgaagttgcttgggaagtgaccaataaagttggaggcatctatactgtgattcagacaaaggccaaaacaacagcagatgaatggggagagaactattttctgataggtccatattttgagcataatatgaagactcaggtggaacagtgtgaacctgtaaatgatgctgtcagaagagcagtggacgcaatgaataagcatggctgccaggtgcattttggaagatggctgatagaaggaagtccttatgtggtactttttgacataggctattcagcttggaatctggacaggtggaagggtgacctctgggaagcatgcagtgtcggcattccttatcatgaccgagaagccaatgatatgctgatatttggatctttaactgcctggttcttaaaagaggtgacagatcatgcagatggtaaatatgtcgttgcccaattccatgaatggcaggctggaattggactgatcctttctcgagccaggaaacttcctattgccacaatatttacaacccacgctacactacttgggaggtatctctgtgcagcaaatattgatttctacaaccatcttgataagtttaacattgacaaagaggctggggaaaggcagatttaccaccggtactgcatggagcgagcttccgttcattgcgctcacgtgttcaccacggtttctgaaataacagcaatagaagctgaacatatgctgaagagaaagcctgatgtagttactccaaacggcttgaatgttaagaaattttcagcagtgcatgagtttcaaaatctacatgccatgtacaaggccagaatccaagattttgttcgaggtcatttctatggtcatctcgactttgatcttgaaaagactttgttccttttcattgctgggaggtatgagttttcaaacaaaggagctgacatcttcctagaatccttatccaggctaaatttcctgctgaggatgcataaaagtgacatcacagtgatggtgtttttcattatgcctgccaagacaaataatttcaacgtggaaaccctgaaaggacaagcagtgcgaaaacagctgtgggatgttgcacattctgtgaaggaaaagtttggaaaaaaactctatgatgcattattaagaggagaaattcctgacctgaacgatattttagatcgagatgatctaacaattatgaaaagagccatcttttcaactcagcgacagtcattgcccccagtgaccacgcacaacatgattgatgactccaccgaccccatcctcagcaccattagacggattggacttttcaacaaccgcacagatagagtcaaggtgattttgcacccagagtttctatcctccaccagtcccttactacccatggactatgaagagtttgttagaggttgtcatcttggagtatttccatcatactatgaaccctggggttatactccagctgaatgcactgtgatgggtatccccagtgtgaccacgaatctctccgggtttggctgtttcatgcaggagcacgtggctgatcctactgcttacggtatttacatcgttgacaggcggttccgttctccagatgattcttgcaatcagctgactaagtttctctatggattttgcaaacagtcacgccgccaaaggattatccagaggaacagaactgagaggctctcagatcttctggattggagatacttaggcagatattaccagcatgccagacacctgacattaagcagagcttttccagataaattccatgtggaactaacatcaccaccaacgacagaaggatttaaatatcccaggccttcctcagtaccaccttctccttcagggtctcaggcctccagtcctcagagcagtgatgtggaagatgaagtggaggatgagagatacgatgaggaagaggaggctgaaagggatcggttaaatatcaagtcaccattttcactgagccacgttcctcatgggaagaaaaagctgcatggtgaatataagaactgaattctacatgtgctgcatgaagagctaatttaaaaaagcaaagtaagactaattatttaaaataaaaatgccacaaatttcattttctccttctaagtattacaatggagtttattctctgcctaattattttccccaactcttgtttcccccataaagttaggcatgaggaggagcactcattaaaggcagaagacggaaaagtgtttttaaaatggtgaatttaagtggtaagtattttctcttactctgtttatttttaaatgatcatcataatcctttgcttactatttatgcagcttctctaccccaccacacaaatttcccatttcccccccgaaaaccttgatcttacccatgaatgtgcactacctacattttttaaatagctaggtttttactgattattttcatttttcacatgcatcagaaccatgatttagatgtagttttgcagagacaaaaatccatgagtgaatagctatcctaagtccatattttgatgcatattaatggacatttatgtcacttttgaaatctagaattgatgttgtaattaatgcaagatattaccatgtacatggtaccaccatcttactgtaacatttttctattgtttaaatagaaagcctttttaaaatttggtcaatcttcatagatgataacttgtaaaatccaagtaaataaacacattaatatttaataacttaaaaaaaannnn

SEQ ID NO: 280325 - DNA, 3668 bp, Homo sapiens
  misc_feature (2247)..(2247): n is a, c, g, or t
  misc_feature (2607)..(2607): n is a, c, g, or t
  misc_feature (3247)..(3247): n is a, c, g, or t
tttatgtatttatttatttgagacggagtttcgctcttgttgcccaggctggaatgtaatggtgcgatctcggctcaccgcagcctctgcctccggggttcaagcgattatcctgcctcagcctccagagtagctgggattacaggcatgcgctgccacgcccggctgattttgtatttttagtagaggcggggtttcaccatgttggccaggctggtctccaactcccgacctcaggtgatccgcctgcttcggcctcccaaaatgctgggattacaggcgtgagccactgcgcccggcctgagaaggggggttttattgggcagaggagatcagcagtggattcaaaggaggcttggaaggaggcaagggtgtcacagagtgggatccttcagggcctgggtatgatgcctgcactaacctcactggacagtagcgtaggctagacaagattttagagatgtgttgtgaccagctgcactccaggaaaactgtttacattatatcttacctcattcatccagcctttgcatttttgtttgcttgtttttgagacagagtctttttctgtcgcccaggctggagtgcagtggcacaatcttggctcactgcaatctccgcctcctgggttcaagcaattctcctgcctcagcctcctgagtagctgggataacaggcacccgccaccatgccctgcccattttttaaattatttttagtggagatggggtttcaccatgttggcctggctggtctcaaactcctgacctcagatgatctacccaccttggccccttggcctcccaaagtgctggaattacaggcgtgagccaccacgcctggcccagcctatgcattttttttttttttttttttttttgagatggagtcttgcaccgtagcctaagctggagtgcagtggtgcgatctcggctcaccgcaacctccgcctcccgggtcctggttcaagcaattttcttgcctcagcctcctgagtagctgggattacaggaacgtgccaccatgcccagctaatttttgtatttttagtagagacggggtttcaccatgttggccaggctggtcttgaactcgtgacctcatgatccgctcacctcggcctcccaaagtgctgggattacaggcatgagccactgacgcctggccagcctatgcatttttaagaaattattctgtattaggtgctgtgctaaacattgggcactacagtgaccaaaacagactgaattccccaagagccaaagaccagtgagggagaccaacaagaaacaggaaatgcaaaagagaccattattactcactatgactaagggccacaaatggggtacgttgatggagagtgatttgttaagagactacagagggaggacagactaccaagaggggggccaggaaagctcctctgacgaggtggtatttcagcccaaactggaagaatgagaaagagctagccagccatcagaatagtccagaagagatggggagcactacactcactacactttggcctgagaaaatagcatgggattggaggaggctgggggaacaccacttctgccgacctgggcaggaggcattgagggcttgagaaagggcaatggcagtagcagtagaaaggacagggtaggagcagggactttgcaggtggaatcattaggtcttatcaacagatatgggcaagcaaagccaggggagaattgatggtaatgctgaggtttggagccaggctagatgggacagtggtgggtgatgcaaaggaaagaggtcaggaagcagggccagacgtggggagaaggtgtgggggtttggtttccatcttgccgagtctgccggaatgtggatgggaagaccaagaggaggagcaaggggcagaggggaagggaatcttaaagaagtcctggatgccacactcttcttccttcctcctcttccctctcctcagaggtctcactcgtggttcttcatttcctgccctgcctccatctcctctgggtgctgggaaagtggaggattagctgaagttttgcttctcggggcctgtctgaatctccattgctttctgggaggacataattcacctgtcctagcttcttatcatcttacatttccctgtagccactgggacatatgtggtgttccttcctagctcctgtctcctcctcatgcctttgctgggtatgggcatgttagggggaaggtcattgctgtcagaggggcactgacttnctaatggtgttacccaaggtgaatgttggagacacagtcgcgatgctgcccaagtcccggcgagccctaactatccaggagatcgctgcgctggccaggtcctccctgcatggtatgcagcccctcccatgtttctggccactttgtcctttctcctcccgtttgcacatccctttggaactgtttcctgtgagtacatgctggggtctcccctttcttcccttgctcaggtgaatctcagccccttctcccacccaaaggttcacatggatcctaactactgccacccttccacctccctgcacctgtgctccctggcctggtcctttaccaggcttctccaccctcccctatctccangtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggtggatggcagaaaggggataagctacactcttggcacagggctgctttctttctttattttatttaatttttttttgagacggagtctcactctgtcgcccaggctggagtgcagtgatgcaatctcagctcactgcaacctctgccaccccagttcaagcgattctcctgcctcagcctcccaagtagctgggattacagttgcctgccaccgtgcctggctaatttttgtagttttagtagagatggggtttcaccgtctaggccaggctggtcttgaactcctgacctagtgatccacctgcctcggcctcccaaagtgctgggattacaggcataagccaccacacccggccagggctgctttcttatctcctcgggtctgacatgggggttggagtcttcccataccctgtttctcctctctcctgtcttcaagctgagccctagacttanctcaccttctctgcttatgcattctgtccctgcgacaggagtggctgagcagtttgccatcgcggaagccaagctccgagcatggtcttcggtggatggcgaggactccactgatgactcctatgatgaggactttgctgggggaatggacacaggtgagggacatcctgggctagggctgtggtggacccacctgatagaccttggcattctttcagagccacatccagaacactctcagcctttgcaaggggagggagagggacagactcagtccaggcaggcctggacactccagggacaggaaggctgtccacactcatgggtgggaaatgagcagacagaaatggattcgttcctttcccacaggtgctgaggcttctctgcctgtctgcacagttgtgccttgcagtcctcaaaa

SEQ ID NO: 280326 - DNA, 673 bp, Homo sapiens
tgaggtttcctggaaggttgggccctcagatgggcttgataggtgccttcctggtccggagaaaagggagattagtgataggacatccttgctaggctctgctctcctaccagaatgattcaagcccctgtgtggggaaggcttttgggtttcgggttgtttatagctggagaatccctttatggcttgaaggtgtcatctgtaaaatgaaggggctggatgcatgaagggaggttttgcgaccccgtgtagtgtgactgggctggcttagtgagtgttcgccgcccctgccttcaggtggcagtcggctctgggaggagaggaccggcattttcgaacccggtccaggccgcctctgcgtggctgtgacgtcgctgcgccccgcctactttgggtggtgacgcggcggtcacgcccccgcgcttacgtcaccggcccggttccctctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcagggtaagaggcggaggccgggtacgggttggggagtcgggctgcggccgc

SEQ ID NO: 280327 - DNA, 2638 bp, Homo sapiens
gggaatgggcctcagctccccgagtcccagagagcttggctgagccctggtgttcccacctcctcagagccatgaggcaggaatgttctccttatgtgactaggcacaggttccaaatggggaggggactggctcagcatccggagccaaaacaggaatagaactggaagctgagcctggagcggttctgggcttttggttctctgcatcaacacagccagcatgcctatgatttctgtgctgggcaaaatgtttctgtggcagcgtgaagggcctggaggacgatggacttgtcagacaagtcgcagagtgtcctcggaccccgcttgggctgtggagtggatcgaacttcctcggggtctctctctatcctctttgggatctgctcgaaccctccgaggctggagcaggtcctcccgcccttcctcggtggacagtcaggacttgccagaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccgccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctctaaaaacatctg

SEQ ID NO: 280328 - DNA, 2871 bp, Homo sapiens
tgaggtttcctggaaggttgggccctcagatgggcttgataggtgccttcctggtccggagaaaagggagattagtgataggacatccttgctaggctctgctctcctaccagaatgattcaagcccctgtgtggggaaggcttttgggtttcgggttgtttatagctggagaatccctttatggcttgaaggtgtcatctgtaaaatgaaggggctggatgcatgaagggaggttttgcgaccccgtgtagtgtgactgggctggcttagtgagtgttcgccgcccctgccttcaggtggcagtcggctctgggaggagaggaccggcattttcgaacccggtccaggccgcctctgcgtggctgtgacgtcgctgcgccccgcctactttgggtggtgacgcggcggtcacgcccccgcgcttacgtcaccggcccggttccctctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcaggcatttctggggaccaacagctggccgaggctcagggatagagacggctgctccagctaaaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccgccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctctaaaaacatctg

SEQ ID NO: 280329 - DNA, 2810 bp, Homo sapiens
tgaggtttcctggaaggttgggccctcagatgggcttgataggtgccttcctggtccggagaaaagggagattagtgataggacatccttgctaggctctgctctcctaccagaatgattcaagcccctgtgtggggaaggcttttgggtttcgggttgtttatagctggagaatccctttatggcttgaaggtgtcatctgtaaaatgaaggggctggatgcatgaagggaggttttgcgaccccgtgtagtgtgactgggctggcttagtgagtgttcgccgcccctgccttcaggtggcagtcggctctgggaggagaggaccggcattttcgaacccggtccaggccgcctctgcgtggctgtgacgtcgctgcgccccgcctactttgggtggtgacgcggcggtcacgcccccgcgcttacgtcaccggcccggttccctctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcagggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccgccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctctaaaaacatctg

SEQ ID NO: 280330 - DNA, 2291 bp, Homo sapiens
agcgaagcgagggagggagagcaagctaagaaacacccagcaggtgctcccccgcctaggcctggctggaggctactggcgccaccctgggggccctgtcagccaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccgccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctctaaaaacatctg

SEQ ID NO: 280331 - DNA, 1866 bp, Homo sapiens
tgaggtttcctggaaggttgggccctcagatgggcttgataggtgccttcctggtccggagaaaagggagattagtgataggacatccttgctaggctctgctctcctaccagaatgattcaagcccctgtgtggggaaggcttttgggtttcgggttgtttatagctggagaatccctttatggcttgaaggtgtcatctgtaaaatgaaggggctggatgcatgaagggaggttttgcgaccccgtgtagtgtgactgggctggcttagtgagtgttcgccgcccctgccttcaggtggcagtcggctctgggaggagaggaccggcattttcgaacccggtccaggccgcctctgcgtggctgtgacgtcgctgcgccccgcctactttgggtggtgacgcggcggtcacgcccccgcgcttacgtcaccggcccggttccctctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcaggcatttctggggaccaacagctggccgaggctcagggatagagacggctgctccagctaaaggtgaatgttggagacacagtcgcgatgctgcccaagtcccggcgagccctaactatccaggagatcgctgcgctggccaggtcctccctgcatggtatttcccaggtggtgaaggaccacgtgaccaaacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccgccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctctaaaaacatctg

SEQ ID NO: 280332 - DNA, 1113 bp, Homo sapiens
gggaatgggcctcagctccccgagtcccagagagcttggctgagccctggtgttcccacctcctcagagccatgaggcaggaatgttctccttatgtgactaggcacaggttccaaatggggaggggactggctcagcatccggagccaaaacaggaatagaactggaagctgagcctggagcggttctgggcttttggttctctgcatcaacacagccagcatgcctatgatttctgtgctgggcaaaatgtttctgtggcagcgtgaagggcctggaggacgatggacttgtcagacaagtcgcagagtgtcctcggaccccgcttgggctgtggagtggatcgaacttcctcggggtctctctctatcctctttgggatctgctcgaaccctccgaggctggagcaggtcctcccgcccttcctcggtggacagtcaggacttgccagaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacaggtgagggacatcctgggctagggctgtggtggacccacctgatagaccttggcattctttcagagccacatccagaacactctcagcctttgcaaggggagggagagggacagactcagtccaggcaggcctggacactccagggacaggaaggctgtccacactcatgggtgggaaatgagcagacagaaatggattcgttcctttcccacaggtgctgaggcttctctgcctgtctgcacagttgtgccttgcagtcctcaaaa

SEQ ID NO: 280333 - DNA, 3014 bp, Homo sapiens
tgaggtttcctggaaggttgggccctcagatgggcttgataggtgccttcctggtccggagaaaagggagattagtgataggacatccttgctaggctctgctctcctaccagaatgattcaagcccctgtgtggggaaggcttttgggtttcgggttgtttatagctggagaatccctttatggcttgaaggtgtcatctgtaaaatgaaggggctggatgcatgaagggaggttttgcgaccccgtgtagtgtgactgggctggcttagtgagtgttcgccgcccctgccttcaggtggcagtcggctctgggaggagaggaccggcattttcgaacccggtccaggccgcctctgcgtggctgtgacgtcgctgcgccccgcctactttgggtggtgacgcggcggtcacgcccccgcgcttacgtcaccggcccggttccctctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcaggcatttctggggaccaacagctggccgaggctcagggatagagacggctgctccagctaaagtgtcctcggaccccgcttgggctgtggagtggatcgaacttcctcggggtctctctctatcctctttgggatctgctcgaaccctccgaggctggagcaggtcctcccgcccttcctcggtggacagtcaggacttgccagaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccgccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctctaaaaacatctg

SEQ ID NO: 280334 - DNA, 3509 bp, Homo sapiens
  misc_feature (1563)..(1563): n is a, c, g, or t
tgaggtttcctggaaggttgggccctcagatgggcttgataggtgccttcctggtccggagaaaagggagattagtgataggacatccttgctaggctctgctctcctaccagaatgattcaagcccctgtgtggggaaggcttttgggtttcgggttgtttatagctggagaatccctttatggcttgaaggtgtcatctgtaaaatgaaggggctggatgcatgaagggaggttttgcgaccccgtgtagtgtgactgggctggcttagtgagtgttcgccgcccctgccttcaggtggcagtcggctctgggaggagaggaccggcattttcgaacccggtccaggccgcctctgcgtggctgtgacgtcgctgcgccccgcctactttgggtggtgacgcggcggtcacgcccccgcgcttacgtcaccggcccggttccctctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcaggcatttctggggaccaacagctggccgaggctcagggatagagacggctgctccagctaaagtgtcctcggaccccgcttgggctgtggagtggatcgaacttcctcggggtctctctctatcctctttgggatctgctcgaaccctccgaggctggagcaggtcctcccgcccttcctcggtggacagtcaggacttgccagaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggtggatggcagaaaggggataagctacactcttggcacagggctgctttctttctttattttatttaatttttttttgagacggagtctcactctgtcgcccaggctggagtgcagtgatgcaatctcagctcactgcaacctctgccaccccagttcaagcgattctcctgcctcagcctcccaagtagctgggattacagttgcctgccaccgtgcctggctaatttttgtagttttagtagagatggggtttcaccgtctaggccaggctggtcttgaactcctgacctagtgatccacctgcctcggcctcccaaagtgctgggattacaggcataagccaccacacccggccagggctgctttcttatctcctcgggtctgacatgggggttggagtcttcccataccctgtttctcctctctcctgtcttcaagctgagccctagacttanctcaccttctctgcttatgcattctgtccctgcgacaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccgccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctctaaaaacatctg

SEQ ID NO: 280335 - DNA, 2278 bp, Homo sapiens
gttcaggaagtcatcaccttctcttgtcagggcatttctggggaccaacagctggccgaggctcagggatagagacggctgctccagctaaaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccgccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctctaaaaacatctg

SEQ ID NO: 280336 - DNA, 1219 bp, Homo sapiens
acctgaagcccgtttactttccaggctggagacttggcaacaacgtgggaatggggaacgggcccgagttaagtcactggcttagccaaggtcacagctggcatctgggtgaacagcgctgcacggtgtccgcggtgcctctagggggcggggcttccggctggcgctgaccggcttccggcggagcgggcgggaggtggggcggagttgctgctcgggggcctctgggtggagggggattcagacgccgcgtctggtgtgtccctttctccttcctgaccttcctcagtctgcagctcttttctccaccgcgcgcccgcctcagccgttcagccctgagctggcgggtggacgggcatggatccaggcggtgggagcagtctgcgaagtcagggtaggaaggctacacaaaggaggcgacatcccagcccggtcctcaggaataagcgggcgtgcccgtgtggtgtggacggtgaggggacactgtattaagtgccttatctgcattatcattgaatcttcatagcaatcgattgtgatgggtactggtcatctccccgggttgtagatgaggaaactgaggcctcagtaactttgctttagtcagtaaatgataagagtcagcaaatgaattcccaagcgtagactcggccgtaccgctgctctaccttgctaataacgacctacctgtaagcgacatttttgacaaaatgtcctttaaacatcttttgtgctcagctctgtattcgtgggccctccaaagggggtacaggcaggtagaagcctccgtccctaccttataggttgtatatatctgaactggtcgactaaagatgcaaagcgaagtgctccagtgagtgtggtacaggttgttgagatgaaggagagatggcaatcagctaaagttactgaatacgtcaggaaggaggctggtttcagctggctgtgattgggaggatcaatgcgaggacattccgagtcggaaacagccaaggcgaagactcacaggtgggtgaagggagtaaacatggctttggaaatatttccagttttctctgaccaactcgtttatcacctagccgtcacatagatcacaccaagaagctgattgatttacggtcacatttctttcatgttgctttggaaaagatactgaagcctcgggcaacataatgagaccccgtctctacaaaaaaaaaaaaaaaagaaagaaaagaaa

SEQ ID NO: 280337 - DNA, 863 bp, Homo sapiens
gaaggctctcaaaaggattgctacagagacacaatgctggacagttatgagaacacggtcccacagggatccttcttacagctctccatgatgcctcagagagctggaaatgatccacctggggtttcaaatgcaagtgaaatggaaatggagataagtaacatgagagaaaagtttcttatgagtgtaacaaagttagtagaaagcaaaagttacaacagcaaggtattttccaaagaaaagtactttcaaacaataaaggaagttaaagaagctaaagaaaaagggaagaagtcatcacgtgattatcgccgtgcagcaaaatatgatgtgatctctgtacagggcacagagaaactgatagaggctactcatggagaacgtgatcgaatacggtattatgtacataaggaagagttgtttgatattcttcatgatacacatctcagtattggacatggtgggcggacacgcatgctcaaggagctgcaaggaaaatatgggaatgtcaccaaagaagttattgtcttatatctgactctgtgtaaacagtgccaccagaagaacccagtacccaagagaggccttgcaccaaagcccatgacttttaaggacatagactccacatgccaagttgaaatacttgacatgcagtccagtgccgatggtgagttcaagttcattttatactaccaggatcactcaaccaagtttattattttacggccattaagaaccaaacaggcccatgaggtggtcagtgtctgttagatattttcacaattcttggtacacccagtgtgttagactctgacagtggcgttgagttcacaaaccaggttgttcatgagctcaatgagttg

SEQ ID NO: 280338 - DNA, 1804 bp, Homo sapiens
acctgaagcccgtttactttccaggctggagacttggcaacaacgtgggaatggggaacgggcccgagttaagtcactggcttagccaaggtcacagctggcatctgggtgaacagcgctgcacggtgtccgcggtgcctctagggggcggggcttccggctggcgctgaccggcttccggcggagcgggcgggaggtggggcggagttgctgctcgggggcctctgggtggagggggattcagacgccgcgtctggtgtgtccctttctccttcctgaccttcctcagtctgcagctcttttctccaccgcgcgcccgcctcagccgttcagccctgagctggcgggtggacgggcatggatccaggcggtgggagcagtctgcgaagtcagggtaggaaggctacacaaaggaggcgacatcccagcccggtcctcaggaataagcgggcgtgcccgtgtggtgtggacggtgaggggacactgtattaagtgccttatctgcattatcattgaatcttcatagcaatcgattgtgatgggtactggtcatctccccgggttgtagatgaggaaactgaggcctcagtaactttgctttagtcagtaaatgataagagtcagcaaatgaattcccaagcgtagactcggccgtaccgctgctctaccttgctaataacgacctacctgtaagcgacatttttgacaaaatgtcctttaaacatcttttgtgctcagctctgtattcgtgggccctccaaagggggtacaggcaggtagaagcctccgtccctaccttataggttgtatatatctgaactggtcgactaaagatgcaaagcgaagtgctccagtgagtgtggtacaggttgttgagatgaaggagagatggcaatcagctaaagttactgaatacgtcaggaaggaggctggtttcagctggctgtgattgggaggatcaatgcgaggacattccgagtcggaaacagccaaggcgaagactcacaggatccttcttacagctctccatgatgcctcagagagctggaaatgatccacctggggtttcaaatgcaagtgaaatggaaatggagataagtaacatgagagaaaagtttcttatgagtgtaacaaagttagtagaaagcaaaagttacaacagcaaggtattttccaaagaaaagtactttcaaacaataaaggaagttaaagaagctaaagaaaaagggaagaagtcatcacgtgattatcgccgtgcagcaaaatatgatgtgatctctgtacagggcacagagaaactgatagaggctactcatggagaacgtgatcgaatacggtattatgtacataaggaagagttgtttgatattcttcatgatacacatctcagtattggacatggtgggcggacacgcatgctcaaggagctgcaaggaaaatatgggaatgtcaccaaagaagttattgtcttatatctgactctgtgtaaacagtgccaccagaagaacccagtacccaagagaggccttgcaccaaagcccatgacttttaaggacatagactccacatgccaagttgaaatacttgacatgcagtccagtgccgatggtgagttcaagttcattttatactaccaggatcactcaaccaagtttattattttacggccattaagaaccaaacaggcccatgaggtggtcagtgtctgttagatattttcacaattcttggtacacccagtgtgttagactctgacagtggcgttgagttcacaaaccaggttgttcatgagctcaatgagttg

SEQ ID NO: 280339 - DNA, 1291 bp, Homo sapiens
tgcaatagagaaagagtttaattcatgcagagccagaacgagagaccagagttaactactcaaatcattctcccggaaaatttagggatgggagtttttttaaggataatttggcaggtagggggccagggagtggggcgtgttgacaggtcgtatcagagatgaaggcatagggagttgaagctgtcttcttgctctgagttggttcctggatgggggccacaagatcagatgagccagtttattgatctgggtggcaccagcggatccatcagtgcagggtcttataggttgtatatatctgaactggtcgactaaagatgcaaagcgaagtgctccagtgagtgtggtacaggttgttgagatgaaggagagatggcaatcagctaaagttactgaatacgtcaggaaggaggctggtttcagctggctgtgattgggaggatcaatgcgaggacattccgagtcggaaacagccaaggcgaagactcacaggatccttcttacagctctccatgatgcctcagagagctggaaatgatccacctggggtttcaaatgcaagtgaaatggaaatggagataagtaacatgagagaaaagtttcttatgagtgtaacaaagttagtagaaagcaaaagttacaacagcaaggtattttccaaagaaaagtactttcaaacaataaaggaagttaaagaagctaaagaaaaagggaagaagtcatcacgtgattatcgccgtgcagcaaaatatgatgtgatctctgtacagggcacagagaaactgatagaggctactcatggagaacgtgatcgaatacggtattatgtacataaggaagagttgtttgatattcttcatgatacacatctcagtattggacatggtgggcggacacgcatgctcaaggagctgcaaggaaaatatgggaatgtcaccaaagaagttattgtcttatatctgactctgtgtaaacagtgccaccagaagaacccagtacccaagagaggccttgcaccaaagcccatgacttttaaggacatagactccacatgccaagttgaaatacttgacatgcagtccagtgccgatggtgagttcaagttcattttatactaccaggatcactcaaccaagtttattattttacggccattaagaaccaaacaggcccatgaggtggtcagtgtctgttagatattttcacaattcttggtacacccagtgtgttagactctgacagtggcgttgagttcacaaaccaggttgttcatgagctcaatgagttg

SEQ ID NO: 280340 - DNA, 976 bp, Homo sapiens
ccccgaacacggaaaaaaaaggcgcagtgggggttctgctgtgtttgcaagtgagggtcgtgagtgcaacgggcgcaaggcattaaggccagtgtgttagtgcgcgggcaggctcgcgtggtgctggggttgctgtgtgagcggccctcgtggctcgggaggtgctgtgtttgcgcaggcgtgcgcccctggcgtcgggactgggactccggatttctgtggcgactgaggcgctcttacctttgcgtcctgatctccaagcaagcacactgaccttcttcaggcaaatacgcactgttaattttccagaaagttctgtgagtaaggtttatacctctcgagtctgccactagatgccgccaaatcccagcaaaggattggctgtttggtccctgggattctgggattttgtttccctcccccctcccctttctgatttgctgaacggtaatatctataggcatcatggatatcgttcattcctaggaaaaaataaaatcaacttctgtaaatagcactagtaggcaggggactgtgacccaagatccaaataattttgctcatttctttccttttctccttgggttaaaaaaaaaaaaaggcccctctccatccctcttttcttttgtccttgccttgtttaatcaaagagttaatgaatgacgcaagcactgatgctgaagatcctaaccctttttcctcaccttttcaaatgctcgcaactcacccaaactgaaaatacagatagctgttccgtcagtaaagatagataagaactcatcagtaaaacctggaccctggtattgaaaactgattttccttttctcttgaaatttgtatcagatatgtgtttttgcaccctattttctgtagtggtattggtaaactttattgtgtctttggagtaagagaaagagacctaattgtaaacctcattccaccacttactagtctcagtaccctgggcaaatgattt

SEQ ID NO: 280341 - DNA, 2367 bp, Homo sapiens
gggggcagatcctggggagaatggaggagcacacagaggcaggctcggcaccagagatgggggcccagaaggccctgattgacaatcctgctgacatcctagtcattgctgcatatttcctgctggtcattggcgttggcttgtggtccatgtgcagaaccaacagaggcactgtgggcggctacttcctggcaggacgcagcatggtgtggtggccggttggggcctctctcttcgccagcaacatcggcagtggccactttgtgggcctggcagggactggcgctgcaagtggcttggctgttgctggattcgagtggaatgcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacgccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccagacgaggtggcgtgcgtggtgcctgaggtgtgcaggcgcgtgtgcggcacggaggtgggctgctccaacatcgcctacccgcggctcgtcgtgaagctcatgcccaacggtctgcgcggactcatgctggcggtcatgctggccgcgctcatgtcctcgctggcctccatcttcaacagcagcagcacgctcttcaccatggacatctacacgcgcctgcggccacgcgccggcgaccgcgagctgctgctggtgggacggctctgggtggtgttcatcgtggtagtgtcggtggcctggcttcccgtggtgcaggcggcacagggcgggcagctcttcgattacatccaggcagtctctagctacctggcaccgcccgtgtccgccgtcttcgtgctggcgctcttcgtgccgcgcgttaatgagcagggcgccttctggggactcatcgggggcctgctgatgggcctggcacgcctgattcccgagttctccttcggctcgggcagctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacctccaccgcctggtcttcagtctccggcatagcaaggaggaacgggaggacctggatgctgatgagcagcaaggctcctcactccctgtacagaatgggtgcccagagagtgccatggagatgaatgagccccaggccccggcaccaagcctcttccgccagtgcctgctctggttttgtggaatgagcagaggtggggtgggcagtcctccgccccttacccaggaggaggcagcggcagcagccaggcggctggaggacatcagcgaggacccgagctgggcccgtgtggtcaacctcaatgccctgctcatgatggcagtggccgtgttcctctggggcttctatgcctaagaccaactgcgttggacaccataagccacagcctcacaggaagtgggggtgaggagcctgcggtgctccccagaaaaggggaaggggcagtggggtgagaaggtcctggctccccttctcccggccttcctctgcctggggcccactgcatctgattggcagtcacttcccatgagggcctggcccacccgctgcagttgccctaaggaaaaataaagctgcctttcccctgtccaaaaaaaacaaaaaataaacataaacaacaacaaaaaaaacaaggcggcacataaagaaaaaacacacaaaaggacacaaataacaacacaac

SEQ ID NO: 280342 - DNA, 3172 bp, Homo sapiens
gggggcagatcctggggagaatggaggagcacacagaggcaggctcggcaccagagatgggggcccagaaggccctgattgacaatcctgctgacatcctagtcattgctgcatatttcctgctggtcattggcgttggcttgtggtccatgtgcagaaccaacagaggcactgtgggcggctacttcctggcaggacgcagcatggtgtggtggccggttggggcctctctcttcgccagcaacatcggcagtggccactttgtgggcctggcagggactggcgctgcaagtggcttggctgttgctggattcgagtggaatgtgaggccctcttttttccaataaccccaccctcagtgagaacacctggaagggtcacaccttggggaaactccaggaaagggggaatgagactggcagtgggacttcccaactgcggggtgtgactgggctgggagtggaggtcatacatctagccaggaagcagaggggtgcaggggtgaccactgttggtcctgcttctgacttgccatgtgagccagcctgcaccagccactgcctctgggagcttccatttattcctctctgagtggggtgagcagcctcaaagccagggaagcacctgctcagatgcgctccgaagctgtggtctgtgaggaatttggggccaagttaaagccctttgcagaagagaggagcagagacaaagctctgggactgaggctcctgttggaggggagattgggctttgagctcagggcttcctggaggaggagactgctgagctgatccttgagggacacaaggtttgggtggctttggctcaggtcagtctgaggggtctatgctggggttcatatctagatgatcatagggacaacattgggaaaaacgggccagaagtgatagcctggggagacaaggagggctccagttaagagcccaggagggtgtcagctctgttccttggtgcccagggccccggggccatcacctgcagttgtcctctgggccccagatgtggcccttcccagggccacttgcttggagtagcaccttcacgaagaggtcagatcctcagggatgagggcaaagccaccctcagcggcagtactgccccccgtaggcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacgccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccagacgaggtggcgtgcgtggtgcctgaggtgtgcaggcgcgtgtgcggcacggaggtgggctgctccaacatcgcctacccgcggctcgtcgtgaagctcatgcccaacggtctgcgcggactcatgctggcggtcatgctggccgcgctcatgtcctcgctggcctccatcttcaacagcagcagcacgctcttcaccatggacatctacacgcgcctgcggccacgcgccggcgaccgcgagctgctgctggtgggacggctctgggtggtgttcatcgtggtagtgtcggtggcctggcttcccgtggtgcaggcggcacagggcgggcagctcttcgattacatccaggcagtctctagctacctggcaccgcccgtgtccgccgtcttcgtgctggcgctcttcgtgccgcgcgttaatgagcagggcgccttctggggactcatcgggggcctgctgatgggcctggcacgcctgattcccgagttctccttcggctcgggcagctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacctccaccgcctggtcttcagtctccggcatagcaaggaggaacgggaggacctggatgctgatgagcagcaaggctcctcactccctgtacagaatgggtgcccagagagtgccatggagatgaatgagccccaggccccggcaccaagcctcttccgccagtgcctgctctggttttgtggaatgagcagaggtggggtgggcagtcctccgccccttacccaggaggaggcagcggcagcagccaggcggctggaggacatcagcgaggacccgagctgggcccgtgtggtcaacctcaatgccctgctcatgatggcagtggccgtgttcctctggggcttctatgcctaagaccaactgcgttggacaccataagccacagcctcacaggaagtgggggtgaggagcctgcggtgctccccagaaaaggggaaggggcagtggggtgagaaggtcctggctccccttctcccggccttcctctgcctggggcccactgcatctgattggcagtcacttcccatgagggcctggcccacccgctgcagttgccctaaggaaaaataaagctgcctttcccctgtccaaaaaaaacaaaaaataaacataaacaacaacaaaaaaaacaaggcggcacataaagaaaaaacacacaaaaggacacaaataacaacacaac

SEQ ID NO: 280343 - DNA, 2043 bp, Homo sapiens
gggggcagatcctggggagaatggaggagcacacagaggcaggctcggcaccagagatgggggcccagaaggccctgattgacaatcctgctgacatcctagtcattgctgcatatttcctgctggtcattggcgttggcttgtggtccatgtgcagaaccaacagaggcactgtgggcggctacttcctggcaggacgcagcatggtgtggtggccggttggggcctctctcttcgccagcaacatcggcagtggccactttgtgggcctggcagggactggcgctgcaagtggcttggctgttgctggattcgagtggaatgtgaggccctcttttttccaataaccccaccctcagtgagaacacctggaagggtcacaccttggggaaactccaggaaagggggaatgagactggcagtgggacttcccaactgcggggtgtgactgggctgggagtggaggtcatacatctagccaggaagcagaggggtgcaggggtgaccactgttggtcctgcttctgacttgccatgtgagccagcctgcaccagccactgcctctgggagcttccatttattcctctctgagtggggtgagcagcctcaaagccagggaagcacctgctcagatgcgctccgaagctgtggtctgtgaggaatttggggccaagttaaagccctttgcagaagagaggagcagagacaaagctctgggactgaggctcctgttggaggggagattgggctttgagctcagggcttcctggaggaggagactgctgagctgatccttgagggacacaaggtttgggtggctttggctcaggtcagtctgaggggtctatgctggggttcatatctagatgatcatagggacaacattgggaaaaacgggccagaagtgatagcctggggagacaaggagggctccagttaagagcccaggagggtgtcagctctgttccttggtgcccagggccccggggccatcacctgcagttgtcctctgggccccagatgtggcccttcccagggccacttgcttggagtagcaccttcacgaagaggtcagatcctcagggatgagggcaaagccaccctcagcggcagtactgccccccgtaggcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacgccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccagacgaggtggcgtgcgtggtgcctgaggtgtgcaggcgcgtgtagatgtccatggtgaagagcgtgctgctgctgttgaagatggaggccagcgaggacatgagcgcggccagcatgaccgccagcatgagtccgcgcagaccgttgggcatgagcttcacgacgagccggggtaggcgatgttggagcaggtggtag

SEQ ID NO: 280344 - DNA, 1739 bp, Homo sapiens
gggggcagatcctggggagaatggaggagcacacagaggcaggctcggcaccagagatgggggcccagaaggccctgattgacaatcctgctgacatcctagtcattgctgcatatttcctgctggtcattggcgttggcttgtggtccatgtgcagaaccaacagaggcactgtgggcggctacttcctggcaggacgcagcatggtgtggtggccggttggggcctctctcttcgccagcaacatcggcagtggccactttgtgggcctggcagggactggcgctgcaagtggcttggctgttgctggattcgagtggaatgtgaggccctcttttttccaataaccccaccctcagtgagaacacctggaagggtcacaccttggggaaactccaggaaagggggaatgagactggcagtgggacttcccaactgcggggtgtgactgggctgggagtggaggtcatacatctagccaggaagcagaggggtgcaggggtgaccactgttggtcctgcttctgacttgccatgtgagccagcctgcaccagccactgcctctgggagcttccatttattcctctctgagtggggtgagcagcctcaaagccagggaagcacctgctcagatgcgctccgaagctgtggtctgtgaggaatttggggccaagttaaagccctttgcagaagagaggagcagagacaaagctctgggactgaggctcctgttggaggggagattgggctttgagctcagggcttcctggaggaggagactgctgagctgatccttgagggacacaaggtttgggtggctttggctcaggtcagtctgaggggtctatgctggggttcatatctagatgatcatagggacaacattgggaaaaacgggccagaagtgatagcctggggagacaaggagggctccagttaagagcccaggagggtgtcagctctgttccttggtgcccagggccccggggccatcacctgcagttgtcctctgggccccagatgtggcccttcccagggccacttgcttggagtagcaccttcacgaagaggtcagatcctcagggatgagggcaaagccaccctcagcggcagtactgccccccgtaggcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacgccttccacgaggagaaatacaatatgcttttgaaatgactagctttaaagaaaaaagtcctgagcttcctaccccagttgtgggatattactccaaaacaactcaagaacccaaattatcttactgcctgattaaatgtaaccactctagctttttaaagacacattcctgttactcacattaatccatctccctcacgtttcaggtttgctggaaggaaaagtagagaaataatggagtagagaagtgggagaatcca

SEQ ID NO: 280345 - DNA, 2374 bp, Homo sapiens
tgatatgacctgattcagctaaacaaagctggggagcgggaatgagacctgggggacttgtcggctcagtgcccctgagtccatgtgcagaaccaacagaggcactgtgggcggctacttcctggcaggacgcagcatggtgtggtggccggtgagacgggctgggccgggaacgggaggggcctggagaagcagccctgctcactccctcctctggccacccaggttggggcctctctcttcgccagcaacatcggcagtggccactttgtgggcctggcagggactggcgctgcaagtggcttggctgttgctggattcgagtggaatgcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacgccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccagacgaggtggcgtgcgtggtgcctgaggtgtgcaggcgcgtgtgcggcacggaggtgggctgctccaacatcgcctacccgcggctcgtcgtgaagctcatgcccaacggtctgcgcggactcatgctggcggtcatgctggccgcgctcatgtcctcgctggcctccatcttcaacagcagcagcacgctcttcaccatggacatctacacgcgcctgcggccacgcgccggcgaccgcgagctgctgctggtgggacggctctgggtggtgttcatcgtggtagtgtcggtggcctggcttcccgtggtgcaggcggcacagggcgggcagctcttcgattacatccaggcagtctctagctacctggcaccgcccgtgtccgccgtcttcgtgctggcgctcttcgtgccgcgcgttaatgagcagggcgccttctggggactcatcgggggcctgctgatgggcctggcacgcctgattcccgagttctccttcggctcgggcagctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacctccaccgcctggtcttcagtctccggcatagcaaggaggaacgggaggacctggatgctgatgagcagcaaggctcctcactccctgtacagaatgggtgcccagagagtgccatggagatgaatgagccccaggccccggcaccaagcctcttccgccagtgcctgctctggttttgtggaatgagcagaggtggggtgggcagtcctccgccccttacccaggaggaggcagcggcagcagccaggcggctggaggacatcagcgaggacccgagctgggcccgtgtggtcaacctcaatgccctgctcatgatggcagtggccgtgttcctctggggcttctatgcctaagaccaactgcgttggacaccataagccacagcctcacaggaagtgggggtgaggagcctgcggtgctccccagaaaaggggaaggggcagtggggtgagaaggtcctggctccccttctcccggccttcctctgcctggggcccactgcatctgattggcagtcacttcccatgagggcctggcccacccgctgcagttgccctaaggaaaaataaagctgcctttcccctgtccaaaaaaaacaaaaaataaacataaacaacaacaaaaaaaacaaggcggcacataaagaaaaaacacacaaaaggacacaaataacaacacaac

SEQ ID NO: 280346 - DNA, 2300 bp, Homo sapiens
tgatatgacctgattcagctaaacaaagctggggagcgggaatgagacctgggggacttgtcggctcagtgcccctgagtccatgtgcagaaccaacagaggcactgtgggcggctacttcctggcaggacgcagcatggtgtggtggccggttggggcctctctcttcgccagcaacatcggcagtggccactttgtgggcctggcagggactggcgctgcaagtggcttggctgttgctggattcgagtggaatgcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacgccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccagacgaggtggcgtgcgtggtgcctgaggtgtgcaggcgcgtgtgcggcacggaggtgggctgctccaacatcgcctacccgcggctcgtcgtgaagctcatgcccaacggtctgcgcggactcatgctggcggtcatgctggccgcgctcatgtcctcgctggcctccatcttcaacagcagcagcacgctcttcaccatggacatctacacgcgcctgcggccacgcgccggcgaccgcgagctgctgctggtgggacggctctgggtggtgttcatcgtggtagtgtcggtggcctggcttcccgtggtgcaggcggcacagggcgggcagctcttcgattacatccaggcagtctctagctacctggcaccgcccgtgtccgccgtcttcgtgctggcgctcttcgtgccgcgcgttaatgagcagggcgccttctggggactcatcgggggcctgctgatgggcctggcacgcctgattcccgagttctccttcggctcgggcagctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacctccaccgcctggtcttcagtctccggcatagcaaggaggaacgggaggacctggatgctgatgagcagcaaggctcctcactccctgtacagaatgggtgcccagagagtgccatggagatgaatgagccccaggccccggcaccaagcctcttccgccagtgcctgctctggttttgtggaatgagcagaggtggggtgggcagtcctccgccccttacccaggaggaggcagcggcagcagccaggcggctggaggacatcagcgaggacccgagctgggcccgtgtggtcaacctcaatgccctgctcatgatggcagtggccgtgttcctctggggcttctatgcctaagaccaactgcgttggacaccataagccacagcctcacaggaagtgggggtgaggagcctgcggtgctccccagaaaaggggaaggggcagtggggtgagaaggtcctggctccccttctcccggccttcctctgcctggggcccactgcatctgattggcagtcacttcccatgagggcctggcccacccgctgcagttgccctaaggaaaaataaagctgcctttcccctgtccaaaaaaaacaaaaaataaacataaacaacaacaaaaaaaacaaggcggcacataaagaaaaaacacacaaaaggacacaaataacaacacaac

SEQ ID NO: 280347 - DNA, 598 bp, Homo sapiens
atgtttctcatggtcatgccaggcatgatcagccgcattctgtacccaggtaacatccctgccccgcccctttcctgtgccagcaaccgggcgcccgtcgcccagttccgtcaccctcctaagactcggcagtttgggcccggagtcccgcctccctccgggggtcgcacgcctcctctgctaggattcccagtccccacctcctgggattcccagaccaggccccgtcctaacggcgcggtggcctctctctggcagacgaggtggcgtgcgtggtgcctgaggtgtgcaggcgcgtgtgcggcacggaggtgggctgctccaacatcgcctacccgcggctcgtcgtgaagctcatgcccaacggtaagggcagccccgggccacaggcgcaagctcgctgcggagcccgctgctgggaggggtcgtccctcgcgcagctgcagccgccctggacccccagtggccccagcctcacggctgccgtcggcccgcaggtctgcgcggactcatgctggcggtcatgctggccgcgctcatgtcctcgctggcctccatcttcaacagcagcagcacgctcttcaccatggacatctac

SEQ ID NO: 280348 - DNA, 850 bp, Homo sapiens
tagatcagcctatatgccctggacaaacttggctgcaatgtgtgctcacacttgaagagtcaggcttttttgtttctggcctccaaggaattttctcattttccttccagcacagctatgtattaataaatgtattttaaaactatttttaatattttacccaacatttttagttgagcagtttctatgactatctagtttgtcatattgctagaaatgaaacactcaaatcttggtataagattttagtagcctactatctaatattgtggcagcatgattttgtgatcagcaaacctttagaatgttttatgcttctgtgtctggtttaataatagctgaaaaagcatcttcacctaaaaatgtttattttagatattagcagtttatgacattgtttactttgtattaactttagctagtgaaatttttttcttttattactttaaggaggtaactgagttctatgttcaaaatgaaaattcagtggacaagtggggaaaacctttagtgattgataaactcaaggtaagaaaatctttaacgctagaaaattcatatgcaagtgttttttgagatcctagaccttagttttgttgttgctattgttatatatgtagaagaaaattatatcaataataacctttaaaaaagaagtattactagatcttacatacaatacgctaaggaggtccatattggtggatgagaacaccccttcactggtcacgggcaaattggtactttctttttgccccggtggaagggcagggggttgccctaatacactcgtttcctcccacgggaaaagcccgtgggcacccgggcggcgccaaacgaaccccccggg

SEQ ID NO: 280349 - DNA, 351 bp, Homo sapiens
tttttagatttgcattccgatcttgggtttattcaacacaattcttccactctacacaacaaagtacaaacacaatgtcatctaaaatgctacaaaggtataaaactcaaaagagaaattttatagtactgactgtacaatgaaagcaaaaaagaaaaaaaaataaaagcaatgtacatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtgagtagatgtcatttaagaatcatct

SEQ ID NO: 280350 - DNA, 3974 bp, Homo sapiens
tgggactccggccgccaacgctcccagcccgggccttcgccgccgccttcgccccacgttgctcggctgggcccgcgaggggtacgtggggaggcacctcgccgctgccttcctagcccagagcccctggggacgtgcacccagcgcctcacagacagacaacgtctccgagactcccacaggccttcctcggagccgcttccggtgcgttcgcagacatcgctccccctcatcaaaaacctggctctttcggcttccttcctcgctgggccggctaaacccggccgcagcagcaccggggtgataagtgtccagggcaggaggccagcgatgttgccttgctaaccgggtatctaagagaaacagggtctttttattcttaggctcgacagtctgacggccctttttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactaggtgaaggtaggggatttgaaatttcccaaggccgccttggacctggcagaatccaccactgtatgagaacagtaggtttggcggaacgcgctttgcagatcatgtgtgagcgggcaacacaaaggatagctttcaagaagaagttgtatgcacatgaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataaggagggtggcactgccacatcccactggcagaaactctcctttatacaaacttcattggctccaacatttgaatctcatatttttgtagcagtttgagcacagggttaattattcatttgtggtaaagattatagcatctattttgatcagtgggttttattatttcaagggtcacacagggttaagttcagtaagaaatgctgtagctgttgtcattcaatctagtgcctccttgaggccaggagttcaggaccagcctgggcaacatagcgagacccccattgctacaaaaaatttaaaaatgaaacaagtgtggtggcacatgcttgtagtcctagctacttgggaggctgaggcaggaggattgcttgagtctaggagtttgaggttacagtaagctgtgatcgtgacatggcctccagcctgggtgaccgagtgagactgtttctaaaaataaaaacaaaaaataaatttcttcttgaggtggggtggaggtggggagcaagaatttgacctggctctgatccctggtgtgttgtgtgggcctctttaacgtttgccactgagccttaacctcactgtacttcactgtacttcacacgcattggtgttaacattttaatcttagaagaccctgacccactgagggtttgttgtgagaattgctgaagccacgtagaagcaccttgaaatctgtaaaaccacaagaaagtactttataaaaggtatccttatttgaagtggataaatcttgtaactcgaaaagttgtgatttagaagacaggattgtttttgaacattaggaattaaaggctatatctggtccttaaaaaaatgtaatttg

SEQ ID NO: 280351 - DNA, 3836 bp, Homo sapiens
tgggactccggccgccaacgctcccagcccgggccttcgccgccgccttcgccccacgttgctcggctgggcccgcgaggggtacgtggggaggcacctcgccgctgccttcctagcccagagcccctggggacgtgcacccagcgcctcacagacagacaacgtctccgagactcccacaggccttcctcggagccgcttccggtgcgttcgcagacatcgctccccctcatcaaaaacctggctctttcggcttccttcctcgctgggccggctaaacccggccgcagcagcaccggggtgataagtgtccagggcaggaggccagcgatgttgccttgctaaccgggtatctaagagaaacagggtctttttattcttaggctcgacagtctgacggccctttttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggctgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactaggtgaaggtaggggatttgaaatttcccaaggccgccttggacctggcagaatccaccactgtatgagaacagtaggtttggcggaacgcgctttgcagatcatgtgtgagcgggcaacacaaaggatagctttcaagaagaagttgtatgcacatgaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataaggagggtggcactgccacatcccactggcagaaactctcctttatacaaacttcattggctccaacatttgaatctcatatttttgtagcagtttgagcacagggttaattattcatttgtggtaaagattatagcatctattttgatcagtgggttttattatttcaagggtcacacagggttaagttcagtaagaaatgctgtagctgttgtcattcaatctagtgcctccttgaggccaggagttcaggaccagcctgggcaacatagcgagacccccattgctacaaaaaatttaaaaatgaaacaagtgtggtggcacatgcttgtagtcctagctacttgggaggctgaggcaggaggattgcttgagtctaggagtttgaggttacagtaagctgtgatcgtgacatggcctccagcctgggtgaccgagtgagactgtttctaaaaataaaaacaaaaaataaatttcttcttgaggtggggtggaggtggggagcaagaatttgacctggctctgatccctggtgtgttgtgtgggcctctttaacgtttgccactgagccttaacctcactgtacttcactgtacttcacacgcattggtgttaacattttaatcttagaagaccctgacccactgagggtttgttgtgagaattgctgaagccacgtagaagcaccttgaaatctgtaaaaccacaagaaagtactttataaaaggtatccttatttgaagtggataaatcttgtaactcgaaaagttgtgatttagaagacaggattgtttttgaacattaggaattaaaggctatatctggtccttaaaaaaatgtaatttg

SEQ ID NO: 280352 - DNA, 4584 bp, Homo sapiens
tgggactccggccgccaacgctcccagcccgggccttcgccgccgccttcgccccacgttgctcggctgggcccgcgaggggtacgtggggaggcacctcgccgctgccttcctagcccagagcccctggggacgtgcacccagcgcctcacagacagacaacgtctccgagactcccacaggccttcctcggagccgcttccggtgcgttcgcagacatcgctccccctcatcaaaaacctggctctttcggcttccttcctcgctgggccggctaaacccggccgcagcagcaccggggtgataagtgtccagggcaggaggccagcgatgttgccttgctaaccgggtatctaagagaaacagggtctttttattcttaggctcgacagtctgacggccctttttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccaggtaattaaacaattctgattgagaaacctgtgtaggaatgagccagtcttcctcctatctaggtaatttacttaaaattcactgtttggactcacaaatcataatgtaagatatgagagtaaatgtcatatatttgtatttcacaagtattttctaacaggtgtttttggaaaacattatagggagtattgctgaacattcttcgctgtggaattttcagtattagaaagtgttgctaaattatcaaagctgtttggattaaattatcagacaaattttttcagacctgtgtaatgaagtgattagatgtttagatcaaaggcaataatcttgaaatgtttaattatatatataagttcccagttaccattgttgagcagtgagaagcttcaatcaaacaactcatttattttcaaatcattgtttctgttccagatcacagcctgcatcagactatgttggtgtacgtcttttacacagttcccattccagtcatcactgcttacatgactacatgaaaacatcaaaaagacaattgtgattctgcttattatctgttttatttttcttcttagcaaactttttctaatacaatttttcttttgactagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactaggtgaaggtaggggatttgaaatttcccaaggccgccttggacctggcagaatccaccactgtatgagaacagtaggtttggcggaacgcgctttgcagatcatgtgtgagcgggcaacacaaaggatagctttcaagaagaagttgtatgcacatgaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataaggagggtggcactgccacatcccactggcagaaactctcctttatacaaacttcattggctccaacatttgaatctcatatttttgtagcagtttgagcacagggttaattattcatttgtggtaaagattatagcatctattttgatcagtgggttttattatttcaagggtcacacagggttaagttcagtaagaaatgctgtagctgttgtcattcaatctagtgcctccttgaggccaggagttcaggaccagcctgggcaacatagcgagacccccattgctacaaaaaatttaaaaatgaaacaagtgtggtggcacatgcttgtagtcctagctacttgggaggctgaggcaggaggattgcttgagtctaggagtttgaggttacagtaagctgtgatcgtgacatggcctccagcctgggtgaccgagtgagactgtttctaaaaataaaaacaaaaaataaatttcttcttgaggtggggtggaggtggggagcaagaatttgacctggctctgatccctggtgtgttgtgtgggcctctttaacgtttgccactgagccttaacctcactgtacttcactgtacttcacacgcattggtgttaacattttaatcttagaagaccctgacccactgagggtttgttgtgagaattgctgaagccacgtagaagcaccttgaaatctgtaaaaccacaagaaagtactttataaaaggtatccttatttgaagtggataaatcttgtaactcgaaaagttgtgatttagaagacaggattgtttttgaacattaggaattaaaggctatatctggtccttaaaaaaatgtaatttg

SEQ ID NO: 280353 - DNA, 4505 bp, Homo sapiens
tgggactccggccgccaacgctcccagcccgggccttcgccgccgccttcgccccacgttgctcggctgggcccgcgaggggtacgtggggaggcacctcgccgctgccttcctagcccagagcccctggggacgtgcacccagcgcctcacagacagacaacgtctccgagactcccacaggccttcctcggagccgcttccggtgcgttcgcagacatcgctccccctcatcaaaaacctggctctttcggcttccttcctcgctgggccggctaaacccggccgcagcagcaccggggtgataagtgtccagggcaggaggccagcgatgttgccttgctaaccgggtatctaagagaaacagggtctttttattcttaggctcgacagtctgacggccctttttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccaggtaattaaacaattctgattgagaaacctgtgtaggaatgagccagtcttcctcctatctaggtaatttacttaaaattcactgtttggactcacaaatcataatgtaagatatgagagtaaatgtcatatatttgtatttcacaagtattttctaacaggtgtttttggaaaacattatagggagtattgctgaacattcttcgctgtggaattttcagtattagaaagtgttgctaaattatcaaagctgtttggattaaattatcagacaaattttttcagacctgtgtaatgaagtgattagatgtttagatcaaaggcaataatcttgaaatgtttaattatatatataagttcccagttaccattgttgagcagtgagaagcttcaatcaaacaactcatttattttcaaatcattgtttctgttccagatcacagcctgcatcagactatgttggtgtacgtcttttacacagttcccattccagtcatcactgcttacatgactacatgaaaacatcaaaaagacaattgtgattctgcttattatctgttttatttttcttcttagcaaactttttctaatacaatttttcttttgactagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactaggtgaaggtaggggatttgaaatttcccaaggccgccttggacctggcagaatccaccactgtatgagaacagtaggtttggcggaacgcgctttgcagatcatgtgtgagcgggcaacacaaaggatagctttcaagaagaagttgtatgcacatgaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccagatggacctgacgaagttcatctttcagcaatcgcaacaatggagctgcgggaccaagccaaaagactgacagccaagatataaggagggtggcactgccacatcccactggcagaaactctcctttatacaaacttcattggctccaacatttgaatctcatatttttgtagcagtttgagcacagggttaattattcatttgtggtaaagattatagcatctattttgatcagtgggttttattatttcaagggtcacacagggttaagttcagtaagaaatgctgtagctgttgtcattcaatctagtgcctccttgaggccaggagttcaggaccagcctgggcaacatagcgagacccccattgctacaaaaaatttaaaaatgaaacaagtgtggtggcacatgcttgtagtcctagctacttgggaggctgaggcaggaggattgcttgagtctaggagtttgaggttacagtaagctgtgatcgtgacatggcctccagcctgggtgaccgagtgagactgtttctaaaaataaaaacaaaaaataaatttcttcttgaggtggggtggaggtggggagcaagaatttgacctggctctgatccctggtgtgttgtgtgggcctctttaacgtttgccactgagccttaacctcactgtacttcactgtacttcacacgcattggtgttaacattttaatcttagaagaccctgacccactgagggtttgttgtgagaattgctgaagccacgtagaagcaccttgaaatctgtaaaaccacaagaaagtactttataaaaggtatccttatttgaagtggataaatcttgtaactcgaaaagttgtgatttagaagacaggattgtttttgaacattaggaattaaaggctatatctggtccttaaaaaaatgtaatttg

SEQ ID NO: 280354 - DNA, 4063 bp, Homo sapiens
tgggactccggccgccaacgctcccagcccgggccttcgccgccgccttcgccccacgttgctcggctgggcccgcgaggggtacgtggggaggcacctcgccgctgccttcctagcccagagcccctggggacgtgcacccagcgcctcacagacagacaacgtctccgagactcccacaggccttcctcggagccgcttccggtgcgttcgcagacatcgctccccctcatcaaaaacctggctctttcggcttccttcctcgctgggccggctaaacccggccgcagcagcaccggggtgataagtgtccagggcaggaggccagcgatgttgccttgctaaccgggtatctaagagaaacagggtctttttattcttaggctcgacagtctgacggccctttttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccaggtaattaaacaattctgattgagaaacctgtgtaggaatgagccagtcttcctcctatctaggtaatttacttaaaattcactgtttggactcacaaatcataatgtaagatatgagagtaaatgtcatatatttgtatttcacaagtattttctaacaggtgtttttggaaaacattatagggagtattgctgaacattcttcgctgtggaattttcagtattagaaagtgttgctaaattatcaaagctgtttggattaaattatcagacaaattttttcagacctgtgtaatgaagtgattagatgtttagatcaaaggcaataatcttgaaatgtttaattatatatataagttcccagttaccattgttgagcagtgagaagcttcaatcaaacaactcatttattttcaaatcattgtttctgttccagatcacagcctgcatcagactatgttggtgtacgtcttttacacagttcccattccagtcatcactgcttacatgactacatgaaaacatcaaaaagacaattgtgattctgcttattatctgttttatttttcttcttagcaaactttttctaatacaatttttcttttgactagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactaggtgaaggtaggggatttgaaatttcccaaggccgccttggacctggcagaatccaccactgtatgagaacagtaggtttggcggaacgcgctttgcagatcatgtgtgagcgggcaacacaaaggatagctttcaagaagaagttgtatgcacatgaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataaggagggtggcactgccacatcccactggcagaaactctcctttatacaaacttcattggctccaacatttgaatctcatatttttgtagcagtttgagcagcgttggccaacgctctcacaagttatttggacacacaggcaactgagcaatgcaaggggtgtcacagtaataaggaaaggaataagaataggaagtaaaaatctttaggttttcttgtttcgtagttgttcttgggtaattttcgattatttaggtgtttgcctgctagtttcattttaaagacagggtcttcttaaagatcggctatcaacttcagaaatag

SEQ ID NO: 280355 - DNA, 2529 bp, Homo sapiens
tgggactccggccgccaacgctcccagcccgggccttcgccgccgccttcgccccacgttgctcggctgggcccgcgaggggtacgtggggaggcacctcgccgctgccttcctagcccagagcccctggggacgtgcacccagcgcctcacagacagacaacgtctccgagactcccacaggccttcctcggagccgcttccggtgcgttcgcagacatcgctccccctcatcaaaaacctggctctttcggcttccttcctcgctgggccggctaaacccggccgcagcagcaccggggtgataagtgtccagggcaggaggccagcgatgttgccttgctaaccgggtatctaagagaaacagggtctttttattcttaggctcgacagtctgacggccctttttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtgcaaagaaaagaaggctctgaagaaagacaccacatagaagaattgctttcattatgtaaaaaccgggtgccaacttttttaaatgactctttttatcattaaagttacttaaaaagttccaa

SEQ ID NO: 280356 - DNA, 1635 bp, Homo sapiens
  misc_feature (1502)..(1502): n is a, c, g, or t
  misc_feature (1505)..(1505): n is a, c, g, or t
tgggactccggccgccaacgctcccagcccgggccttcgccgccgccttcgccccacgttgctcggctgggcccgcgaggggtacgtggggaggcacctcgccgctgccttcctagcccagagcccctggggacgtgcacccagcgcctcacagacagacaacgtctccgagactcccacaggccttcctcggagccgcttccggtgcgttcgcagacatcgctccccctcatcaaaaacctggctctttcggcttccttcctcgctgggccggctaaacccggccgcagcagcaccggggtgataagtgtccagggcaggaggccagcgatgttgccttgctaaccgggtatctaagagaaacagggtctttttattcttaggctcgacagtctgacggccctttttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgttcgagttatangcngtgctggatggggagcctgcaaccatggtcctccttggcgacttgtcaatttccgttctacttgggcccggccgtccctggtacacacggttcctcggcaaccggggtcccccaggcgcaacgcgtccta

SEQ ID NO: 280357 - DNA, 3920 bp, Homo sapiens
tgggactccggccgccaacgctcccagcccgggccttcgccgccgccttcgccccacgttgctcggctgggcccgcgaggggtacgtggggaggcacctcgccgctgccttcctagcccagagcccctggggacgtgcacccagcgcctcacagacagacaacgtctccgagactcccacaggccttcctcggagccgcttccggtgcgttcgcagacatcgctccccctcatcaaaaacctggctctttcggcttccttcctcgctgggccggctaaacccggccgcagcagcaccggggtgataagtgtccagggcaggaggccagcgatgttgccttgctaaccgggtatctaagagaaacagggtctttttattcttaggctcgacagtctgacggccctttttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaatccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactaggtgaaggtaggggatttgaaatttcccaaggccgccttggacctggcagaatccaccactgtatgagaacagtaggtttggcggaacgcgctttgcagatcatgtgtgagcgggcaacacaaaggatagctttcaagaagaagttgtatgcacatgaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataaggagggtggcactgccacatcccactggcagaaactctcctttatacaaacttcattggctccaacatttgaatctcatatttttgtagcagtttgagcacagggttaattattcatttgtggtaaagattatagcatctattttgatcagtgggttttattatttcaagggtcacacagggttaagttcagtaagaaatgctgtagctgttgtcattcaatctagtgcctccttgaggccaggagttcaggaccagcctgggcaacatagcgagacccccattgctacaaaaaatttaaaaatgaaacaagtgtggtggcacatgcttgtagtcctagctacttgggaggctgaggcaggaggattgcttgagtctaggagtttgaggttacagtaagctgtgatcgtgacatggcctccagcctgggtgaccgagtgagactgtttctaaaaataaaaacaaaaaataaatttcttcttgaggtggggtggaggtggggagcaagaatttgacctggctctgatccctggtgtgttgtgtgggcctctttaacgtttgccactgagccttaacctcactgtacttcactgtacttcacacgcattggtgttaacattttaatcttagaagaccctgacccactgagggtttgttgtgagaattgctgaagccacgtagaagcaccttgaaatctgtaaaaccacaagaaagtactttataaaaggtatccttatttgaagtggataaatcttgtaactcgaaaagttgtgatttagaagacaggattgtttttgaacattaggaattaaaggctatatctggtccttaaaaaaatgtaatttg

SEQ ID NO: 280358 - DNA, 4466 bp, Homo sapiens
tgggactccggccgccaacgctcccagcccgggccttcgccgccgccttcgccccacgttgctcggctgggcccgcgaggggtacgtggggaggcacctcgccgctgccttcctagcccagagcccctggggacgtgcacccagcgcctcacagacagacaacgtctccgagactcccacaggccttcctcggagccgcttccggtgcgttcgcagacatcgctccccctcatcaaaaacctggctctttcggcttccttcctcgctgggccggctaaacccggccgcagcagcaccggggtgataagtgtccagggcaggaggccagcgatgttgccttgctaaccgggtatctaagagaaacagggtctttttattcttaggctcgacagtctgacggccctttttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaagcagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccaggtaattaaacaattctgattgagaaacctgtgtaggaatgagccagtcttcctcctatctaggtaatttacttaaaattcactgtttggactcacaaatcataatgtaagatatgagagtaaatgtcatatatttgtatttcacaagtattttctaacaggtgtttttggaaaacattatagggagtattgctgaacattcttcgctgtggaattttcagtattagaaagtgttgctaaattatcaaagctgtttggattaaattatcagacaaattttttcagacctgtgtaatgaagtgattagatgtttagatcaaaggcaataatcttgaaatgtttaattatatatataagttcccagttaccattgttgagcagtgagaagcttcaatcaaacaactcatttattttcaaatcattgtttctgttccagatcacagcctgcatcagactatgttggtgtacgtcttttacacagttcccattccagtcatcactgcttacatgactacatgaaaacatcaaaaagacaattgtgattctgcttattatctgttttatttttcttcttagcaaactttttctaatacaatttttcttttgactagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactaggtgaaggtaggggatttgaaatttcccaaggccgccttggacctggcagaatccaccactgtatgagaacagtaggtttggcggaacgcgctttgcagatcatgtgtgagcgggcaacacaaaggatagctttcaagaagaagttgtatgcacatgaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataaggagggtggcactgccacatcccactggcagaaactctcctttatacaaacttcattggctccaacatttgaatctcatatttttgtagcagtttgagcacagggttaattattcatttgtggtaaagattatagcatctattttgatcagtgggttttattatttcaagggtcacacagggttaagttcagtaagaaatgctgtagctgttgtcattcaatctagtgcctccttgaggccaggagttcaggaccagcctgggcaacatagcgagacccccattgctacaaaaaatttaaaaatgaaacaagtgtggtggcacatgcttgtagtcctagctacttgggaggctgaggcaggaggattgcttgagtctaggagtttgaggttacagtaagctgtgatcgtgacatggcctccagcctgggtgaccgagtgagactgtttctaaaaataaaaacaaaaaataaatttcttcttgaggtggggtggaggtggggagcaagaatttgacctggctctgatccctggtgtgttgtgtgggcctctttaacgtttgccactgagccttaacctcactgtacttcactgtacttcacacgcattggtgttaacattttaatcttagaagaccctgacccactgagggtttgttgtgagaattgctgaagccacgtagaagcaccttgaaatctgtaaaaccacaagaaagtactttataaaaggtatccttatttgaagtggataaatcttgtaactcgaaaagttgtgatttagaagacaggattgtttttgaacattaggaattaaaggctatatctggtccttaaaaaaatgtaatttg

SEQ ID NO: 280359 - DNA, 4127 bp, Homo sapiens
tgggactccggccgccaacgctcccagcccgggccttcgccgccgccttcgccccacgttgctcggctgggcccgcgaggggtacgtggggaggcacctcgccgctgccttcctagcccagagcccctggggacgtgcacccagcgcctcacagacagacaacgtctccgagactcccacaggccttcctcggagccgcttccggtgcgttcgcagacatcgctccccctcatcaaaaacctggctctttcggcttccttcctcgctgggccggctaaacccggccgcagcagcaccggggtgataagtgtccagggcaggaggccagcgatgttgccttgctaaccgggtatctaagagaaacagggtctttttattcttaggctcgacagtctgacggccctttttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccaggtaattaaacaattctgattgagaaacctgtgtaggaatgagccagtcttcctcctatctaggtaatttacttaaaattcactgtttggactcacaaatcataatgtaagatatgagagtaaatgtcatatatttgtatttcacaagtattttctaacaggtgtttttggaaaacattatagggagtattgctgaacattcttcgctgtggaattttcagtattagaaagtgttgctaaattatcaaagctgtttggattaaattatcagacaaattttttcagacctgtgtaatgaagtgattagatgtttagatcaaaggcaataatcttgaaatgtttaattatatatataagttcccagttaccattgttgagcagtgagaagcttcaatcaaacaactcatttattttcaaatcattgtttctgttccagatcacagcctgcatcagactatgttggtgtacgtcttttacacagttcccattccagtcatcactgcttacatgactacatgaaaacatcaaaaagacaattgtgattctgcttattatctgttttatttttcttcttagcaaactttttctaatacaatttttcttttgactagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactaggtgaaggtaggggatttgaaatttcccaaggccgccttggacctggcagaatccaccactgtatgagaacagtaggtttggcggaacgcgctttgcagatcatgtgtgagcgggcaacacaaaggatagctttcaagaagaagttgtatgcacatgaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataaggagggtggcactgccacatcccactggcagaaactctcctttatacaaacttcattggctccaacatttgaatctcatatttttgtagcagtttgagcacagggttaattattcatttgtggtaaagattatagcatctattttgatcagtgggttttattatttcaagggtcacacagggttaagttcagtaagaaatgctgtagctgttgtcattcaatctagtgcctccttgaggccaggagttcaggaccagcctgggcaacatagcgagaccccatgggtactttcaaatgcaggggggggcccaggctggagcctaacaactggaggcgaggcggaggatgctgaactagagttggggtacgaaccggatcgctgggcccc

SEQ ID NO: 280360 - DNA, 2333 bp, Homo sapiens
tgggactccggccgccaacgctcccagcccgggccttcgccgccgccttcgccccacgttgctcggctgggcccgcgaggggtacgtggggaggcacctcgccgctgccttcctagcccagagcccctggggacgtgcacccagcgcctcacagacagacaacgtctccgagactcccacaggccttcctcggagccgcttccggtgcgttcgcagacatcgctccccctcatcaaaaacctggctctttcggcttccttcctcgctgggccggctaaacccggccgcagcagcaccggggtgataagtgtccagggcaggaggccagcgatgttgccttgctaaccgggtatctaagagaaacagggtctttttattcttaggctcgacagtctgacggccctttttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagtttactacattaattgaaaacataattttttctaatattttgatcagtgtttaaaatttctatatatgataagaatgtgtttttatacaaagttattgacttatgaatttagctataattttacttttcagtt

SEQ ID NO: 280361 - DNA, 910 bp, Homo sapiens
cctccgccggggctctgcccgctcgcctgctcgcctggtgggggagaggggagcggggccgacacaggactgcagttgacagcagataactgaaagctcggaaagcgaaaccgtggataagcaggggaactgtggcatcccatttaaaattgcttctgaagagaagcatgaggttacatctgtaatctccctgcagcagagtcaactgcataagaaaccaaaagacacacctgctccatgccagcctaagccaccacataaaaagtcagaccatctgctggaagaaccacatggagaggccctgagtcaacatggagaggaagaaggacttgactgaatccagccttccagctgtccctaccaaggtgccaggcatgagaatgaagctgtcttgaactctgaagaccagcttagccaccaggtaaatgccactaagtgacctcactcaatgtcatgtgggacggaagaatcaccccgccaaacccttcctgggtccctgacccagaaatttgtcagatgtaatggttgtgaaaagccattcaatttgggggcagttttgtatgcagcatagctagctggtatgatacaacagcctgcaattcaggcagcagcagcactaacaacgagtgaaatcctgcaggagcgaactcctttggggtgcctgcctaattgttttcttttctgagagtctcctccccagtatcccctaaaccaccatcctgcatctttctcccccactagcctccgtgggagacatatgacccacattgggccaggtggattctctccctcccaactcccttcctcccttccacagttgatgggagtagacatttgactagagctgggccaggcagatcctctctcccagatatgtgggaccaggaatcagaggtggctgatcattctg

SEQ ID NO: 280362 - DNA, 834 bp, Homo sapiens
cctccgccggggctctgcccgctcgcctgctcgcctggtgggggagaggggagcggggccgacacaggactgcagttgacagcagataactgaaagctcggaaagcgaaaccgtggataagcaggggaactgtggcatcccatttaaaattgcttctgaagagaagcatgaggttacatctgtaatctccctgcagcagagtcaactgcataagaaaccaaaagacacacctgctccatgccagcttcgataatttctttgtaccttcggcgaaagaagcccatctgaaaggcagaaagaaagagaagctgagttagaagtgctgaagaatcagccattgtgaccccaaggcagtctgtccctgggtaggtgtgacctgcactcacagggctggggaggcttggaggacccctcggattagagaaaacactggcaagaaaaacatcctgtggagacatttttcaaaatgcatggacttcctgcgggtgatattacgtaagctgtttgttccttctaaaatgcatctggtgtagtgttttccagactgtgtgctggggaataccagttactgagagctgttcaaaggtgtttgggagtaaaaaaaggtttcatggctgggcgcagtggctcacgcctgtaatcccagcactttgggaggctgagacaggcagaccacttgaggtcaggagtttgagagcagcctggccaacatggtgaaaccctgtctctactaaaaatacaaaaattagctgggcatggtggtgtgtgcctgtaatcccagctacttgggaggctggggcacgagaatcgcttgaacctgggaggcggaggttg

SEQ ID NO: 280363 - DNA, 709 bp, Homo sapiens
cctccgccggggctctgcccgctcgcctgctcgcctggtgggggagaggggagcggggccgacacaggactgcagttgacagcagataactgaaagctcggaaagcgaaaccgtggataagcaggggaactgtggcatcccatttaaaattgcttctgaagagaagcatgaggttacatctgtaatctccctgcagcagagtcaactgcataagaaaccaaaagacacacctgctccatgccagcctaagccaccacataaaaagtcagaccatctgctggaagaaccacatggagaggccctgagtcaacatggagaggaagaaggacttgactgaatccagccttccagctgtccctaccaaggtgccaggcatgagaatgaagctgtcttgaactctgaagaccagcttagccaccagatgccaaacactgagcaggctttgttctccacccacaaaccagaggctgtctcagcaggaaggagttggagttggagaaaaaggagaattaagaatctatctggcgatgtggattaaataaacaacaaattggcagattgtttttaaaaggccagctttccagggcatgattaactacgtttctcctgttcttcatctttatagtttctgtgggcctcaagcaacactttctgcattttcccctctcgccccctactcatcactccctgaaaggtaagtagagttggg

SEQ ID NO: 280364 - DNA, 903 bp, Homo sapiens
cctccgccggggctctgcccgctcgcctgctcgcctggtgggggagaggggagcggggccgacacagggttcctgaccaagctggtgcttctgcgtgtgttcctgcatgacttggtgtgtccccttctcttggatctactgcagttgacagcagataactgaaagctcggaaagcgaaaccgtggataagcaggggaactgtggcatcccatttaaaattgcttctgaagagaagcatgaggttacatctgtaatctccctgcagcagagtcaactgcataagaaaccaaaagacacacctgctccatgccagcttcgataatttctttgtaccttcggcgaaagaagcccatctgaaaggcagaaagaaagagaagctgagttagaagtgctgaagaatcagccattgtgaccccaaggcagtctgtccctgggtaggtgtgacctgcactcacagggctggggaggcttggaggacccctcggattagagaaaacactggcaagaaaaacatcctgtggagacatttttcaaaatgcatggacttcctgcgggtgatattacgtaagctgtttgttccttctaaaatgcatctggtgtagtgttttccagactgtgtgctggggaataccagttactgagagctgttcaaaggtgtttgggagtaaaaaaaggtttcatggctgggcgcagtggctcacgcctgtaatcccagcactttgggaggctgagacaggcagaccacttgaggtcaggagtttgagagcagcctggccaacatggtgaaaccctgtctctactaaaaatacaaaaattagctgggcatggtggtgtgtgcctgtaatcccagctacttgggaggctggggcacgagaatcgcttgaacctgggaggcggaggttg

SEQ ID NO: 280365 - DNA, 3243 bp, Homo sapiens
  misc_feature (2245)..(2245): n is a, c, g, or t
ttttttttgtttgcagccattttttattccaaacatgtatgtttttgtaaacctgacatttcccaaacagtgcaagtgaatcagaagtgactgcttagactttaatacacgtgacattgtgaggcagcacaacctccccccacccaccaaaattcctcagtggaaatgtacatggatgcatcagtaaagttctggaaatgcagatagcgtgggtgcctgccaagcaattaatcactcgtaaagcttttaaactcactctgccagtcacaccgtgcacattagaattaaaacaacaacatcaacaaagaaaaaaccttaacacagtctgaaatctagatcattgtgctataaagcattgcacgatgttgggaaatttgttcacttattccccccatgtgctgaaaattcagaagacatcctagaagtttcattttggccctactggctctgtattctcccttcagccactctttgaatattctccactgtgtatattattattctatatatcaaaatatcagctaaaagtgtgcatactaaagcatttctgaaatgatgctcactttctgccttttgtctactaaaggctccaagtgacaatcctttccagcacctctaaattttgagaagtttgagccaagtatacagttcaccagatgtacgtttcacacgtaacccagacataactgcatgcacctggccataatgccttacccaaaaataaaagtcataaataaccttttaaaaagccaccatgctagggttcaacaggtagcatacagcacacggatcgtctggggatctgctatgcttccgcatggaaaacaggatgttcccaggagtgctgttgggtttttgttttaaacctcattgcctttggctcaagggcagtagctacatgatttggtgaaggaggacttcctagtggatcttctacaaggtctaccatacctctgagtacccatgatgctgacagttttcctaaagaactgcctgaggaaacctcagtgctgagttattcggaatggatgcctgtcagttgccactaagccagtggaccctgcccctcctgctagtgtccccttgtttctaaacatcatggcctcttctttgtgacagctctatggcccacttggaggatgttccaaactctcctgagtcctatgtaaattaagcataagcaaaactttttttaaaaaaggggcactgttttactccatttttacaaaggtcctttttcatatttaaaaaccatttcagttctctgaacagttggttaaaaccacattgaagattcaactaaaagctgaaggaaactgaaataatactgctcaggagaatatcttataggattccacagtgaaaccatggaagcaggaaggggagaaagtagaacatactgtagaattttcaaataatattctggaagggtaacacagatgtactgatccaccccatctgcttcccctgagagcatagagagggcttctgagctgggaaggagcttgtgaactgcccaagttgagagagcgctaacgatatgcttgacttctctatcactgcacaaaatgcttaactccccagtccccgtagcccacctgctactcagcacgatcagaccagcagaggcatcatccttccccagacaggttcctggggaggctttcagtatctgctggtggtgatgccaaggctggttttcttaaaacctgcctttataaagtcttagtgacctcctgggtatacagctgctcatgtgggtccacccacgcagaatcaagcagaagcaaataggtcccagctctgagactgcccacaggagtctacccttctccagtggggctttgctggtgggcagaacatgggcctgcgaatcacccttctacactgtcaccaacgcacctacaccccggcaggaggcaagttagttgctctaagtgcatgtggccaaagctgttgatggtgctgttccagaaatatcacctaagaatcctaaatgattcattaaagaaaacatggcattatgaacaagagtccatcaaaggaaagctgcaaatggcatcccattcaaaaagtccacatgccactgcattttgccaccctgaggcaaaatgtccctgaagtgttctctggggaacctccagcaccttgcacagtgcctgacacacagcaggggcctcataaatggctgttaataagtgataaaacccacccaagactgcttttcttgctgcttttgataaanctcataagcgaactctgagtgacagctgctttctttgcctcgtcctgctccctgtagctacctctgtgcctccatcccacagttagatgcaacatccctgatttccaggatcagcttagttcatgccattgacccttgatttttttggtctattcccatgttcaccaggaagagaagcatgaggttacatctgtaatctccctgcagcagagtcaactgcataagaaaccaaaagacacacctgctccatgccaggttagtacccacccatcaccctcataattttgccaaaactttagatatgtttgtgagtattagccaagtatgtgtattaaaaatctgtcttcccagaagttgagtttgatgtctttttgacaatgttcacggactcccaacgtgttagcttccagtaaaaaaggtgctataagaaagacccttggttttatagattgtttcatccgcactggatgccatgtgtatgtagctggcactttggcaggctgtaataagccattaagactccgttagaccctgctcttagccccatgttttctgtcttattagatggttatccatcagtaggaatagcagccatagctgttaacagttattgagtgatcactatgggccaggtcagcgctgagcatgctacatccatcatctcattgccctttcagaaaatcacactgcactcaaaactaagcagcacagtgcatctgacaatatatctactgtcaaacagagagcttggatactgaaggccgtaactcagcactcacacattcagggggtggggaggggcagtgttctgctcagatcctttgcatcatttcttttgcatcatttccctgtgtctcccctggctgaggatgcatctgtggttgtcctttagaggactgtcctgagctactggagccattacgccagcaggaattgagaataaaacgtttacatctcctctgggtgcagccagccccttgattcaggttgggacacct

SEQ ID NO: 280366 - DNA, 3152 bp, Homo sapiens
  misc_feature (2245)..(2245): n is a, c, g, or t
ttttttttgtttgcagccattttttattccaaacatgtatgtttttgtaaacctgacatttcccaaacagtgcaagtgaatcagaagtgactgcttagactttaatacacgtgacattgtgaggcagcacaacctccccccacccaccaaaattcctcagtggaaatgtacatggatgcatcagtaaagttctggaaatgcagatagcgtgggtgcctgccaagcaattaatcactcgtaaagcttttaaactcactctgccagtcacaccgtgcacattagaattaaaacaacaacatcaacaaagaaaaaaccttaacacagtctgaaatctagatcattgtgctataaagcattgcacgatgttgggaaatttgttcacttattccccccatgtgctgaaaattcagaagacatcctagaagtttcattttggccctactggctctgtattctcccttcagccactctttgaatattctccactgtgtatattattattctatatatcaaaatatcagctaaaagtgtgcatactaaagcatttctgaaatgatgctcactttctgccttttgtctactaaaggctccaagtgacaatcctttccagcacctctaaattttgagaagtttgagccaagtatacagttcaccagatgtacgtttcacacgtaacccagacataactgcatgcacctggccataatgccttacccaaaaataaaagtcataaataaccttttaaaaagccaccatgctagggttcaacaggtagcatacagcacacggatcgtctggggatctgctatgcttccgcatggaaaacaggatgttcccaggagtgctgttgggtttttgttttaaacctcattgcctttggctcaagggcagtagctacatgatttggtgaaggaggacttcctagtggatcttctacaaggtctaccatacctctgagtacccatgatgctgacagttttcctaaagaactgcctgaggaaacctcagtgctgagttattcggaatggatgcctgtcagttgccactaagccagtggaccctgcccctcctgctagtgtccccttgtttctaaacatcatggcctcttctttgtgacagctctatggcccacttggaggatgttccaaactctcctgagtcctatgtaaattaagcataagcaaaactttttttaaaaaaggggcactgttttactccatttttacaaaggtcctttttcatatttaaaaaccatttcagttctctgaacagttggttaaaaccacattgaagattcaactaaaagctgaaggaaactgaaataatactgctcaggagaatatcttataggattccacagtgaaaccatggaagcaggaaggggagaaagtagaacatactgtagaattttcaaataatattctggaagggtaacacagatgtactgatccaccccatctgcttcccctgagagcatagagagggcttctgagctgggaaggagcttgtgaactgcccaagttgagagagcgctaacgatatgcttgacttctctatcactgcacaaaatgcttaactccccagtccccgtagcccacctgctactcagcacgatcagaccagcagaggcatcatccttccccagacaggttcctggggaggctttcagtatctgctggtggtgatgccaaggctggttttcttaaaacctgcctttataaagtcttagtgacctcctgggtatacagctgctcatgtgggtccacccacgcagaatcaagcagaagcaaataggtcccagctctgagactgcccacaggagtctacccttctccagtggggctttgctggtgggcagaacatgggcctgcgaatcacccttctacactgtcaccaacgcacctacaccccggcaggaggcaagttagttgctctaagtgcatgtggccaaagctgttgatggtgctgttccagaaatatcacctaagaatcctaaatgattcattaaagaaaacatggcattatgaacaagagtccatcaaaggaaagctgcaaatggcatcccattcaaaaagtccacatgccactgcattttgccaccctgaggcaaaatgtccctgaagtgttctctggggaacctccagcaccttgcacagtgcctgacacacagcaggggcctcataaatggctgttaataagtgataaaacccacccaagactgcttttcttgctgcttttgataaanctcataagcgaactctgagtgacagctgctttctttgcctcgtcctgctccctgtagctacctctgtgcctccatcccacagttagatgcaacatccctgatttccaggatcagcttagttcatgccattgacccttgatttttttggtctattcccatgttcaccaggaagagaagcatgaggttacatctgtaatctccctgcagcagagtcaactgcataagaaaccaaaagacacacctgctccatgccagcttcgataatttctttgtaccttcggcgaaagaagcccatctgaaaggcagaaagaaagagaagctgagttagaagtgctgaagaatcagccattgtgaccccaaggcagtctgtccctggcctaagccaccacataaaaagtcagaccatctgctggaagaaccacatggagaggccctgagtcaacatggagaggaagaaggacttgactgaatccagccttccagctgtccctaccaaggtgccaggcatgagaatgaagctgtcttgaactctgaagaccagcttagccaccagatgccaaacactgagcaggctttgttctccacccacaaaccagaggctgtctcagcaggaaggagttggagttggagaaaaaggagaattaagaatctatctggcgatgtggattaaataaacaacaaattggcagattgtttttaaaagagaagtatggactttggtgtcaggaagttgcagttatggtccctggtgctgttttggagctggggacacagtggaaacaaggaagagacagaccttcatcagctaaagcctccaataccattactgatgaatagagaggctctgaaggaaaaggactccgggtctctgaaaggagagtgtgaggcaaacaaatcatcctagaca

SEQ ID NO: 280367 - DNA, 3188 bp, Homo sapiens
  misc_feature (2190)..(2190): n is a, c, g, or t
ttttttttgtttgcagccattttttattccaaacatgtatgtttttgtaaacctgacatttcccaaacagtgcaagtgaatcagaagtgactgcttagactttaatacacgtgacattgtgaggcagcacaacctccccccacccaccaaaattcctcagtggaaatgtacatggatgcatcagtaaagttctggaaatgcagatagcgtgggtgcctgccaagcaattaatcactcgtaaagcttttaaactcactctgccagtcacaccgtgcacattagaattaaaacaacaacatcaacaaagaaaaaaccttaacacagtctgaaatctagatcattgtgctataaagcattgcacgatgttgggaaattttttggccctactggctctgtattctcccttcagccactctttgaatattctccactgtgtatattattattctatatatcaaaatatcagctaaaagtgtgcatactaaagcatttctgaaatgatgctcactttctgccttttgtctactaaaggctccaagtgacaatcctttccagcacctctaaattttgagaagtttgagccaagtatacagttcaccagatgtacgtttcacacgtaacccagacataactgcatgcacctggccataatgccttacccaaaaataaaagtcataaataaccttttaaaaagccaccatgctagggttcaacaggtagcatacagcacacggatcgtctggggatctgctatgcttccgcatggaaaacaggatgttcccaggagtgctgttgggtttttgttttaaacctcattgcctttggctcaagggcagtagctacatgatttggtgaaggaggacttcctagtggatcttctacaaggtctaccatacctctgagtacccatgatgctgacagttttcctaaagaactgcctgaggaaacctcagtgctgagttattcggaatggatgcctgtcagttgccactaagccagtggaccctgcccctcctgctagtgtccccttgtttctaaacatcatggcctcttctttgtgacagctctatggcccacttggaggatgttccaaactctcctgagtcctatgtaaattaagcataagcaaaactttttttaaaaaaggggcactgttttactccatttttacaaaggtcctttttcatatttaaaaaccatttcagttctctgaacagttggttaaaaccacattgaagattcaactaaaagctgaaggaaactgaaataatactgctcaggagaatatcttataggattccacagtgaaaccatggaagcaggaaggggagaaagtagaacatactgtagaattttcaaataatattctggaagggtaacacagatgtactgatccaccccatctgcttcccctgagagcatagagagggcttctgagctgggaaggagcttgtgaactgcccaagttgagagagcgctaacgatatgcttgacttctctatcactgcacaaaatgcttaactccccagtccccgtagcccacctgctactcagcacgatcagaccagcagaggcatcatccttccccagacaggttcctggggaggctttcagtatctgctggtggtgatgccaaggctggttttcttaaaacctgcctttataaagtcttagtgacctcctgggtatacagctgctcatgtgggtccacccacgcagaatcaagcagaagcaaataggtcccagctctgagactgcccacaggagtctacccttctccagtggggctttgctggtgggcagaacatgggcctgcgaatcacccttctacactgtcaccaacgcacctacaccccggcaggaggcaagttagttgctctaagtgcatgtggccaaagctgttgatggtgctgttccagaaatatcacctaagaatcctaaatgattcattaaagaaaacatggcattatgaacaagagtccatcaaaggaaagctgcaaatggcatcccattcaaaaagtccacatgccactgcattttgccaccctgaggcaaaatgtccctgaagtgttctctggggaacctccagcaccttgcacagtgcctgacacacagcaggggcctcataaatggctgttaataagtgataaaacccacccaagactgcttttcttgctgcttttgataaanctcataagcgaactctgagtgacagctgctttctttgcctcgtcctgctccctgtagctacctctgtgcctccatcccacagttagatgcaacatccctgatttccaggatcagcttagttcatgccattgacccttgatttttttggtctattcccatgttcaccaggaagagaagcatgaggttacatctgtaatctccctgcagcagagtcaactgcataagaaaccaaaagacacacctgctccatgccaggttagtacccacccatcaccctcataattttgccaaaactttagatatgtttgtgagtattagccaagtatgtgtattaaaaatctgtcttcccagaagttgagtttgatgtctttttgacaatgttcacggactcccaacgtgttagcttccagtaaaaaaggtgctataagaaagacccttggttttatagattgtttcatccgcactggatgccatgtgtatgtagctggcactttggcaggctgtaataagccattaagactccgttagaccctgctcttagccccatgttttctgtcttattagatggttatccatcagtaggaatagcagccatagctgttaacagttattgagtgatcactatgggccaggtcagcgctgagcatgctacatccatcatctcattgccctttcagaaaatcacactgcactcaaaactaagcagcacagtgcatctgacaatatatctactgtcaaacagagagcttggatactgaaggccgtaactcagcactcacacattcagggggtggggaggggcagtgttctgctcagatcctttgcatcatttcttttgcatcatttccctgtgtctcccctggctgaggatgcatctgtggttgtcctttagaggactgtcctgagctactggagccattacgccagcaggaattgagaataaaacgtttacatctcctctgggtgcagccagccccttgattcaggttgggacacct

SEQ ID NO: 280368 - DNA, 1151 bp, Homo sapiens
ctttggggccactattcattcaagtaagggtgacttgaacccaagcaccataataccactgcagtcgagctgttaaccaagacgaagtgactaacgggcaggcgcgtggctgattcacatcccaggtgggacggagcaggatgtgtaagatttcattacgctactcaaaacggcatgcaacttaacacttacaaaatatttatttctggaattttccatttaatattttcagactgcagttgacagcagataactgaaagctcggaaagcgaaaccgtggataagcaggggaactgtggcatcccatttaaaattgcttctgaagagaagcatgaggttacatctgtaatctccctgcagcagagtcaactgcataagaaaccaaaagacacacctgctccatgccaggttagtacccacccatcaccctcataattttgccaaaactttagatatgtttgtgagtattagccaagtatgtgtattaaaaatctgtcttcccagaagttgagtttgatgtctttttgacaatgttcacggactcccaacgtgttagcttccagtaaaaaaggtgctataagaaagacccttggttttatagattgtttcatccgcactggatgccatgtgtatgtagctggcactttggcaggctgtaataagccattaagactccgttagaccctgctcttagccccatgttttctgtcttattagatggttatccatcagtaggaatagcagccatagctgttaacagttattgagtgatcactatgggccaggtcagcgctgagcatgctacatccatcatctcattgccctttcagaaaatcacactgcactcaaaactaagcagcacagtgcatctgacaatatatctactgtcaaacagagagcttggatactgaaggccgtaactcagcactcacacattcagggggtggggaggggcagtgttctgctcagatcctttgcatcatttcttttgcatcatttccctgtgtctcccctggctgaggatgcatctgtggttgtcctttagaggactgtcctgagctactggagccattacgccagcaggaattgagaataaaacgtttacatctcctctgggtgcagccagccccttgattcaggttgggacacct

SEQ ID NO: 280369 - DNA, 1113 bp, Homo sapiens
cttgagtgaattatataactatttaatagaaataataaaacatcgatacaaatataaaagacataatcagtataaaaggcttatatttataaaaatactttaggtaacagttttcccctgagggttgaccatgcgtgttgcatccataaatattgctcggctctgtagctcactctccaaagttcagagttcatctttaaaggaagtggtgctggccccggtcgtgtgacctggccgaagtggctgcctcaggctggcacctgggcttgatagaatgaagaagagaacagcatcagtggggcctccgaaaaatctggagaagatttttttcttccaaatatggaagatacaaagaccaaggatgacaggctagtgatcaggtcatgtgactggtgtggcagctcactggtttttctggacccagtcccaactgtcttcattctctttccggttcttctcagcttcgataatttctttgtaccttcggcgaaagaagcccatctgaaaggcagaaagaaagagaagctgagttagaagtgctgaagaatcagccattgtgaccccaaggcagtctgtccctggcctaagccaccacataaaaagtcagaccatctgctggaagaaccacatggagaggccctgagtcaacatggagaggaagaaggacttgactgaatccagccttccagctgtccctaccaaggtgccaggcatgagaatgaagctgtcttgaactctgaagaccagcttagccaccagatgccaaacactgagcaggctttgttctccacccacaaaccagaggctgtctcagcaggaaggagttggagttggagaaaaaggagaattaagaatctatctggcgatgtggattaaataaacaacaaattggcagattgtttttaaaagagaagtatggactttggtgtcaggaagttgcagttatggtccctggtgctgttttggagctggggacacagtggaaacaaggaagagacagaccttcatcagctaaagcctccaataccattactgatgaatagagaggctctgaaggaaaaggactccgggtctctgaaaggagagtgtgaggcaaacaaatcatcctagaca

SEQ ID NO: 280370 - DNA, 448 bp, Homo sapiens
tattccatagcacggctcccacgcagctcactacagacatgaccagagcagcaggaaccaaagggagacccgcccattgtcactttcttaatctctgatctcttgagctgtttctggcaaagcctgccgtgtcttacatttgtctctctatccggattagatgttgctatatgaacacatcgggactgtgtctgcaggaaggagctccccattcgaggccttcacagtgtcacccacattcacctctttccacttaaacgtgtcccatgaatcttgtcataacagttttgtgttccttaactattttgtctgccatgtcatttatgatgtatataacctctttaatgcctgaaatcataagaataatcatcaaaggcaagagggttgtatattttcccgttggagacacatctggaatttgctgcaataaaataataataagaaagca

SEQ ID NO: 280371 - DNA, 1557 bp, Homo sapiens
tgtggtctatgaagaagtgatgaaaatagaaattagttttattttatgagccatgtgttataatacatagaaaaaaatgcaccaattacaaagcgggccacaaaaaggaataaacgtaaagccgacaacgcagtcactagggaaagggtgaagacacgggaaccacgcagcccgccgtccacgtgcaccgggtagccacggggccctagccgaacgacgcggacgcgaagtgggcgggcccggccaagccacgcctccgcgccagacgccgcagtagagcgggcagggcgctgcgcccaagagccacagacgcaagcccagtgccacaggccgcgggggcggggaggacggcgcccggggacagagaacatgggacgcagagcggtccaaggccccggcgccctggtgaggcccaaacctcccgccatgccccggccccaacgagacccaagccccctgtcccggcccagcgcccgcgggggacccaagccccagcctggtccacctcggaggcctctaggacccgggggcgcccggcggcccgcccggctcccacaaatagactcctgggcgggcgcctgagcccccaaaatagatcctcagggcccaaaagcagactcttcggcgggcgccatgggaccggcagaagctgggcgccgcggggccgcctcgcccgtacctccaccgttggtgcgcgtcgcgccctcactcttcctcgggagcgcgcgagccgcgggcgcggaggagcagctggcgcgcgcgggagtcacgctgtgcgtcaacgtctcccgccagcagcccggcccgcgcgcgcccggcgtggcagagctgcgcgtgcccgtgttcgacgacccggctgaggacctgctggcgcacctggagcccacgtgcgccgccatggaggccgcggtgcgcgccggcggcgcctgcctagtctactgcaagaacggccgcagccgctcggccgccgtctgcaccgcgtacctcatgcggcaccgcggcctcagcctggcgaaggccttccagatggtgaagagcgctcgcccggtagcagaaccgaacccgggcttctggtctcagctccagaagtatgaggaggccctccaggcccagtcctgcctgcagggagagcccccagccttagggttgggccctgaggcttgaagcttgaaggcctgctgcctggaggaaggatgtccctgcactgatacagaagctgtttctggcaaagcctgccgtgtcttacatttgtctctctatccggattagatgttgctatatgaacacatcgggactgtgtctgcaggaaggagctccccattcgaggccttcacagtgtcacccacattcacctctttccacttaaacgtgtcccatgaatcttgtcataacagttttgtgttccttaactattttgtctgccatgtcatttatgatgtatataacctctttaatgcctgaaatcataagaataatcatcaaaggcaagagggttgtatattttcccgttggagacacatctggaatttgctgcaataaaataataataagaaagca

SEQ ID NO: 280372 - DNA, 1809 bp, Homo sapiens
tgtggtctatgaagaagtgatgaaaatagaaattagttttattttatgagccatgtgttataatacatagaaaaaaatgcaccaattacaaagcgggccacaaaaaggaataaacgtaaagccgacaacgcagtcactagggaaagggtgaagacacgggaaccacgcagcccgccgtccacgtgcaccgggtagccacggggccctagccgaacgacgcggacgcgaagtgggcgggcccggccaagccacgcctccgcgccagacgccgcagtagagcgggcagggcgctgcgcccaagagccacagacgcaagcccagtgccacaggccgcgggggcggggaggacggcgcccggggacagagaacatgggacgcagagcggtccaaggccccggcgccctggtgaggcccaaacctcccgccatgccccggccccaacgagacccaagccccctgtcccggcccagcgcccgcgggggacccaagccccagcctggtccacctcggaggcctctaggacccgggggcgcccggcggcccgcccggctcccacaaatagactcctgggcgggcgcctgagcccccaaaatagatcctcagggcccaaaagcagactcttcggcgggcgccatgggaccggcagaagctgggcgccgcggggccgcctcgcccgtacctccaccgttggtgcgcgtcgcgccctcactcttcctcgggagcgcgcgagccgcgggcgcggaggagcagctggcgcgcgcgggagtcacgctgtgcgtcaacgtctcccgccagcagcccggcccgcgcgcgcccggcgtggcagagctgcgcgtgcccgtgttcgacgacccggctgaggacctgctggcgcacctggagcccacgtgcgccgccatggaggccgcggtgcgcgccggcggcgcctgcctagtctactgcaagaacggccgcagccgctcggccgccgtctgcaccgcgtacctcatgcggcaccgcggcctcagcctggcgaaggccttccaggtgggcgggcctttaggggggcggtgtttcgagaggggcgtgtcttccggggacgagttttccgggcggggccggcttcgggattgggacaggcacttccgggaggggcgggtctctctcgtgagggcgggcttagggaagcagagaggcacttccgggttgggcggggcccactcttacagctgggcccgccttggcccctgctggccattagcgcgacttggggttattcagtacacttcttgtttgcagatggtgaagagcgctcgcccggtagcagaaccgaacccgggcttctggtctcagctccagaagtatgaggaggccctccaggcccagtcctgcctgcagggagagcccccagccttagggttgggccctgaggcttgaagcttgaaggcctgctgcctggaggaaggatgtccctgcactgatacagaagctgtttctggcaaagcctgccgtgtcttacatttgtctctctatccggattagatgttgctatatgaacacatcgggactgtgtctgcaggaaggagctccccattcgaggccttcacagtgtcacccacattcacctctttccacttaaacgtgtcccatgaatcttgtcataacagttttgtgttccttaactattttgtctgccatgtcatttatgatgtatataacctctttaatgcctgaaatcataagaataatcatcaaaggcaagagggttgtatattttcccgttggagacacatctggaatttgctgcaataaaataataataagaaagca

SEQ ID NO: 280373 - DNA, 1323 bp, Homo sapiens
tgtggtctatgaagaagtgatgaaaatagaaattagttttattttatgagccatgtgttataatacatagaaaaaaatgcaccaattacaaagcgggccacaaaaaggaataaacgtaaagccgacaacgcagtcactagggaaagggtgaagacacgggaaccacgcagcccgccgtccacgtgcaccgggtagccacggggccctagccgaacgacgcggacgcgaagtgggcgggcccggccaagccacgcctccgcgccagacgccgcagtagagcgggcagggcgctgcgcccaagagccacagacgcaagcccagtgccacaggccgcgggggcggggaggacggcgcccggggacagagaacatgggacgcagagcggtccaaggccccggcgccctggtgaggcccaaacctcccgccatgccccggccccaacgagacccaagccccctgtcccggcccagcgcccgcgggggacccaagccccagcctggtccacctcggaggcctctaggacccgggggcgcccggcggcccgcccggctcccacaaatagactcctgggcgggcgcctgagcccccaaaatagatcctcagggcccaaaagcagactcttcggcgggcgccatgggaccggcagaagctgggcgccgcggggccgcctcgcccgtacctccaccgttggtgcgcgtcgcgccctcactcttcctcgggagcgcgcgagccgcgggcgcggaggagcagctggcgcgcgcgggagtcacgctgtgcgtcaacgtctcccgccagcagcccggcccgcgcgcgcccggcgtggcagagctgcgcgtgcccgtgttcgacgacccggctgaggacctgctggcgcacctggagcccacgtgcgccgccatggaggccgcggtgcgcgccggcggcgcctgcctagtctactgcaagaacggccgcagccgctcggccgccgtctgcaccgcgtacctcatgcggcaccgcggcctcagcctggcgaaggccttccagatggtgaagagcgctcgcccggtagcagaaccgaacccgggcttctggtctcagctccagaagtatgaggaggccctccaggcccagtcctgcctgcagggagagcccccagccttagggttgggccctgaggcttgaagcttgaaggcctgctgcctggaggaaggatgtccctgcactgatacagaaggctggtctttacccttcttcctcactgtcatatcgagttttcctttgtgtgtgtgtgtgtgaaacatagtgcttttaattttatatttccggctgaggtgatgcaca

SEQ ID NO: 280374 - DNA, 991 bp, Homo sapiens
tattccatagcacggctcccacgcagctcactacagacatgaccagagcagcaggaaccaaagggagacccgcccattgtcactttcttaatctctgatctcttgaggtgatttgacagaattctgcaggaatttggtttcaaagccagtgtaaacaactatgccagtgatccactgagcatttcttttttttttttcttgagacggagtctcactctggtgcccaggctggagtgggcgccatcttggctcactgcaagctccgcctcccggcttcatgccattctcgtccttcagcctcctgagtggctgggattacaggcgcccgccaccacgcctagctaatttctttgtatttttggtagagacggggtttcactgtgttagccaggatggtctcaatctcctgacctcatgatcctcccgcctcggcctcccaaagcgctgggattacaggcgtgagccacctcgcccggccaatccactgagcatttctaagctgtgtatctcttaacaagacccagtcaggccctattggaacagggcttttaccacctaggcggaagctcagccattgaaatgacgatcaggtgcttcacggtctatttttccagataggcctaacagctggttttctgtttgcatttcagctgtttctggcaaagcctgccgtgtcttacatttgtctctctatccggattagatgttgctatatgaacacatcgggactgtgtctgcaggaaggagctccccattcgaggccttcacagtgtcacccacattcacctctttccacttaaacgtgtcccatgaatcttgtcataacagttttgtgttccttaactattttgtctgccatgtcatttatgatgtatataacctctttaatgcctgaaatcataagaataatcatcaaaggcaagagggttgtatattttcccgttggagacacatctggaatttgctgcaataaaataataataagaaagca

SEQ ID NO: 280375 - DNA, 1658 bp, Homo sapiens
tgtggtctatgaagaagtgatgaaaatagaaattagttttattttatgagccatgtgttataatacatagaaaaaaatgcaccaattacaaagcgggccacaaaaaggaataaacgtaaagccgacaacgcagtcactagggaaagggtgaagacacgggaaccacgcagcccgccgtccacgtgcaccgggtagccacggggccctagccgaacgacgcggacgcgaagtgggcgggcccggccaagccacgcctccgcgccagacgccgcagtagagcgggcagggcgctgcgcccaagagccacagacgcaagcccagtgccacaggccgcgggggcggggaggacggcgcccggggacagagaacatgggacgcagagcggtccaaggccccggcgccctggtgaggcccaaacctcccgccatgccccggccccaacgagacccaagccccctgtcccggcccagcgcccgcgggggacccaagccccagcctggtccacctcggaggcctctaggacccgggggcgcccggcggcccgcccggctcccacaaatagactcctgggcgggcgcctgagcccccaaaatagatcctcagggcccaaaagcagactcttcggcgggcgccatgggaccggcagaagctgggcgccgcggggccgcctcgcccgtacctccaccgttggtgcgcgtcgcgccctcactcttcctcgggagcgcgcgagccgcgggcgcggaggagcagctggcgcgcgcgggagtcacgctgtgcgtcaacgtctcccgccagcagcccggcccgcgcgcgcccggcgtggcagagctgcgcgtgcccgtgttcgacgacccggctgaggacctgctggcgcacctggagcccacgtgcgccgccatggaggccgcggtgcgcgccggcggcgcctgcctagtctactgcaagaacggccgcagccgctcggccgccgtctgcaccgtgatacccgtcaatgtcggacaaccggcgggtgctcagtccctggacgatgggtcattccagactggttgaagagagcgtctctgtccgcgggtatgcatgagactctgataccgcggcgtcttcgtggtctcagctccataagtatgcggagtccctcctgtctccgctccgtgcctgcatgggaggagtcgccccagtccttcgggtttggtgcgcccttggaagtggccgttgcacaggcgtttgcatatggccatgacctgcactttgtgatggacagggaagttggtcccctttgtcgatctcgtaataccatgataggactagtatattcgttggtcaagaagactctgactcgtgtcttacatttgtctctctatccggattagatgttgctatatgaacacatcgggactgtgtctgcaggaaggagctccccattcgaggccttcacagtgtcacccacattcacctctttccacttaaacgtgtcccatgaatcttgtcataacagttttgtgttccttaactattttgtctgccatgtcatttatgatgtatataacctctttaatgcctgaaatcataagaataatcatcaaaggcaagagggttgtatattttcccgttggagacacatctggaatttgctgcaataaaataataataagaaagca

SEQ ID NO: 280376 - DNA, 1785 bp, Homo sapiens
tgtggtctatgaagaagtgatgaaaatagaaattagttttattttatgagccatgtgttataatacatagaaaaaaatgcaccaattacaaagcgggccacaaaaaggaataaacgtaaagccgacaacgcagtcactagggaaagggtgaagacacgggaaccacgcagcccgccgtccacgtgcaccgggtagccacggggccctagccgaacgacgcggacgcgaagtgggcgggcccggccaagccacgcctccgcgccagacgccgcagtagagcgggcagggcgctgcgcccaagagccacagacgcaagcccagtgccacaggccgcgggggcggggaggacggcgcccggggacagagaacatgggacgcagagcggtccaaggccccggcgccctggtgaggcccaaacctcccgccatgccccggccccaacgagacccaagccccctgtcccggcccagcgcccgcgggggacccaagccccagcctggtccacctcggaggcctctaggacccgggggcgcccggcggcccgcccggctcccacaaatagactcctgggcgggcgcctgagcccccaaaatagatcctcagggcccaaaagcagactcttcggcgggcgccatgggaccggcagaagctgggcgccgcggggccgcctcgcccgtacctccaccgttggtgcgcgtcgcgccctcactcttcctcgggagcgcgcgagccgcgggcgcggaggagcagctggcgcgcgcgggagtcacgctgtgcgtcaacgtctcccgccagcagcccggcccgcgcgtgcccgtgttcgacgacccggctgaggacctgctggcgcacctggagcccacgtgcgccgccatggaggccgcggtgcgcgccggcggcgcctgcctagtctactgcaagaacggccgcagccgctcggccgccgtctgcaccgcgtacctcatgcggcaccgcggcctcagcctggcgaaggccttccaggtgggcgggcctttaggggggcggtgtttcgagaggggcgtgtcttccggggacgagttttccgggcggggccggcttcgggattgggacaggcacttccgggaggggcgggtctctctcgtgagggcgggcttagggaagcagagaggcacttccgggttgggcggggcccactcttacagctgggcccgccttggcccctgctggccattagcgcgacttggggttattcagtacacttcttgtttgcagatggtgaagagcgctcgcccggtagcagaaccgaacccgggcttctggtctcagctccagaagtatgaggaggccctccaggcccagtcctgcctgcagggagagcccccagccttagggttgggccctgaggcttgaagcttgaaggcctgctgcctggaggaaggatgtccctgcactgatacagaagctgtttctggcaaagcctgccgtgtcttacatttgtctctctatccggattagatgttgctatatgaacacatcgggactgtgtctgcaggaaggagctccccattcgaggccttcacagtgtcacccacattcacctctttccacttaaacgtgtcccatgaatcttgtcataacagttttgtgttccttaactattttgtctgccatgtcatttatgatgtatataacctctttaatgcctgaaatcataagaataatcatcaaaggcaagagggttgtatattttcccgttggagacacatctggaatttgctgcaataaaataataataagaaagca

SEQ ID NO: 280377 - DNA, 1756 bp, Homo sapiens
tgtggtctatgaagaagtgatgaaaatagaaattagttttattttatgagccatgtgttataatacatagaaaaaaatgcaccaattacaaagcgggccacaaaaaggaataaacgtaaagccgacaacgcagtcactagggaaagggtgaagacacgggaaccacgcagcccgccgtccacgtgcaccgggtagccacggggccctagccgaacgacgcggacgcgaagtgggcgggcccggccaagccacgcctccgcgccagacgccgcagtagagcgggcagggcgctgcgcccaagagccacagacgcaagcccagtgccacaggccgcgggggcggggaggacggcgcccggggacagagaacatgggacgcagagcggtccaaggccccggcgccctggtgaggcccaaacctcccgccatgccccggccccaacgagacccaagccccctgtcccggcccagcgcccgcgggggacccaagccccagcctggtccacctcggaggcctctaggacccgggggcgcccggcggcccgcccggctcccacaaatagactcctgggcgggcgcctgagcccccaaaatagatcctcagggcccaaaagcagactcttcggcgggcgccatgggaccggcagaagctgggcgccgcggggccgcctcgcccgtacctccaccgttggtgcgcgtcgcgccctcactcttcctcgggagcgcgcgagccgcgggcgcggaggagcagctggcgcgcgcgggagtcacgctgtgcgtcaacgtctcccgccagcagcccggcccgcgcgcgcccggcgtggcagagctgcgcgtgcccgtgttcgacgacccggctgaggacctgctggcgcacctggagcccacgtgcgccgccatggaggccgcggtgcgcgccggcggcgcctgcctagtctactgcaagaacggccgcagccgctcggccgccgtctgcaccgcgtacctcatgcggcaccgcggcctcagcctggcgaaggccttccaggtgggcgggcctttaggggggcggtgtttcgagaggggcgtgtcttccggggacgagttttccgggcggggccggcttcgggattgggacaggcacttccgggaggggcgggtctctctcgtgagggcgggcttagggaagcagagaggcacttccgggttgggcggggcccactcttacagctgggcccgccttggcccctgctggccattagcgcgacttggggttattcagtacacttcttgtttgcagatggtgaagagcgctcgcccggtagcagaaccgaacccgggcttctggtctcagctccagaagtatgaggaggccctccaggcccagtcctgcctgcagggagagcccccagccttagggttgggccctgaggcttgaagcttgaaggcctgctgcctggaggaaggatgtccctgcactgatacagaagatgttgctatatgaacacatcgggactgtgtctgcaggaaggagctccccattcgaggccttcacagtgtcacccacattcacctctttccacttaaacgtgtcccatgaatcttgtcataacagttttgtgttccttaactattttgtctgccatgtcatttatgatgtatataacctctttaatgcctgaaatcataagaataatcatcaaaggcaagagggttgtatattttcccgttggagacacatctggaatttgctgcaataaaataataataagaaagca

SEQ ID NO: 280378 - DNA, 374 bp, Homo sapiens
gtgggttgaccgtggctgtgggttgaccgtggcttacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattcgtgaggccctggggctgatc

SEQ ID NO: 280379 - DNA, 4409 bp, Homo sapiens
  misc_feature (2360)..(2362): n is a, c, g, or t
  misc_feature (2868)..(2868): n is a, c, g, or t
  misc_feature (3348)..(3348): n is a, c, g, or t
  misc_feature (3369)..(3369): n is a, c, g, or t
agacgagaagagaggaggggaggcctcctccgccgccgccatcttggaccgggcccggtcagcttccgcggagccatcggcagacgccgcggcctcccttgagccccgacccccgtcgtcagaacaaccccgggcccactcccccaaccccacttccgcttcgcgccgctatcgcgatagcgcccgggcccggggcgcgagacaaaggcggcgggcgctcgcctcccccgcctgtcgcgatacgctcctcagcggcggcgccagctcctgtgcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggcggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagnnncagcagggcccccggggcagcctcgggccccccggcttcgccgccaccgccgccgtcccccctcgggctggaggggtgagggcactaaggcacagtatctggcagccaaggccctaaagaagcagtcatggcgattccacaccaagtacatgatgtggttccagaggcacgaggagcccaagaccatcactgacgagtttgagcaggtgagggccccgccccctctcttcccgctgctagggttggggtagagtccccaggctccaggcagcccctgctggcctctgctcccttgcctccacctttcagctggcgcagtccctcagcctgaccaagtactcctccctctggctgtctgctcagcctggaacaccgccctctcatcctccacttggccagctcctaggcctcctgtaggtctcagcccaaatgtcccttcctcaaagaaaccttcctggagccacccagcccagtgcctcccctttgcagtgctgggcacactcgcntggggtgtgggattttcccagtatgtgtccctgcaccaggctgtgggctctgctgccgagggaccttgatggcccccacttcacctccaggtcccagcactcagcagggcaggggctcagtgccgaaactattttttttgaatgggcttctcaagttctaatactgggaaattcctgctgcttgcaaacactctggaaccaacctacctgggtttcagcccagtccagctgggcgactctaggcaagtcactcgaacctctgtgtctcaattaacttatctgtaaaatggggggagacacctacctaatgcagttgttatgaagattaaatgagttaataacatgtaagtacttaatggtgactgctacatagtcagtgtcatggattttttttttcaaattactttcagttggtgtgttctacagtgatgtttttttccaccaaatacttccctgatgccgagccccttcatggggatnaagtagtacaaggtccttgtnctcagagaactcagtcccctctcctggttctcccaggttgccatctttgaagcacttaagacattcatttagaacctaggtcctctcccattgtgtcctcagatgttaaccacagacttcctgtcctttcctggtttggcccaaaaccatcctccaagttagtacatttcagggcatccagtcattcagaaattcccacaccacttccgtcaccaataaaatgtccctgcagagtgcttggatttagactctgagactgttccattctctagaacaagggtgacagtacccactgcctcgaggtctttgtgaagattaaatgctaggctgtgcatcctgtactcacgtgagaggtgctcaaaagccacagccctcgaggaaacgaaggctgtgcactcacacctggggctggggccccgtctctggcagctggcttcggtggaacctctgcggccccctccgtttcctcctcgctgaagtggcatgataacatttcctacccaagaagaaccttgtgaggatggatgagagtgtgtgcgtgcagggcagctggcccggttgcctgacacatccacagccctaagaattgtcccctttgtctgttggtccggcccagatcccagaccacctcctcgtccactcactgaccgccttctcccccggccagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatga

SEQ ID NO: 280380 - DNA, 4105 bp, Homo sapiens
  misc_feature (2056)..(2058): n is a, c, g, or t
  misc_feature (2564)..(2564): n is a, c, g, or t
  misc_feature (3044)..(3044): n is a, c, g, or t
  misc_feature (3065)..(3065): n is a, c, g, or t
cccacgcgtccggggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggcggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagnnncagcagggcccccggggcagcctcgggccccccggcttcgccgccaccgccgccgtcccccctcgggctggaggggtgagggcactaaggcacagtatctggcagccaaggccctaaagaagcagtcatggcgattccacaccaagtacatgatgtggttccagaggcacgaggagcccaagaccatcactgacgagtttgagcaggtgagggccccgccccctctcttcccgctgctagggttggggtagagtccccaggctccaggcagcccctgctggcctctgctcccttgcctccacctttcagctggcgcagtccctcagcctgaccaagtactcctccctctggctgtctgctcagcctggaacaccgccctctcatcctccacttggccagctcctaggcctcctgtaggtctcagcccaaatgtcccttcctcaaagaaaccttcctggagccacccagcccagtgcctcccctttgcagtgctgggcacactcgcntggggtgtgggattttcccagtatgtgtccctgcaccaggctgtgggctctgctgccgagggaccttgatggcccccacttcacctccaggtcccagcactcagcagggcaggggctcagtgccgaaactattttttttgaatgggcttctcaagttctaatactgggaaattcctgctgcttgcaaacactctggaaccaacctacctgggtttcagcccagtccagctgggcgactctaggcaagtcactcgaacctctgtgtctcaattaacttatctgtaaaatggggggagacacctacctaatgcagttgttatgaagattaaatgagttaataacatgtaagtacttaatggtgactgctacatagtcagtgtcatggattttttttttcaaattactttcagttggtgtgttctacagtgatgtttttttccaccaaatacttccctgatgccgagccccttcatggggatnaagtagtacaaggtccttgtnctcagagaactcagtcccctctcctggttctcccaggttgccatctttgaagcacttaagacattcatttagaacctaggtcctctcccattgtgtcctcagatgttaaccacagacttcctgtcctttcctggtttggcccaaaaccatcctccaagttagtacatttcagggcatccagtcattcagaaattcccacaccacttccgtcaccaataaaatgtccctgcagagtgcttggatttagactctgagactgttccattctctagaacaagggtgacagtacccactgcctcgaggtctttgtgaagattaaatgctaggctgtgcatcctgtactcacgtgagaggtgctcaaaagccacagccctcgaggaaacgaaggctgtgcactcacacctggggctggggccccgtctctggcagctggcttcggtggaacctctgcggccccctccgtttcctcctcgctgaagtggcatgataacatttcctacccaagaagaaccttgtgaggatggatgagagtgtgtgcgtgcagggcagctggcccggttgcctgacacatccacagccctaagaattgtcccctttgtctgttggtccggcccagatcccagaccacctcctcgtccactcactgaccgccttctcccccggccagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatga

SEQ ID NO: 280381 - DNA, 3675 bp, Homo sapiens
aaattctccctgggggtaaggtaccagccctgtcctttatgggcttcttgttctaaagcatatccgtcccatatggttgctgctagtcacatgtggtgattagtaactagttaaaaatgaaaaattcagttcctccattacacttgccacatttcagatgttcagtggccaacagatatgcgcaaatagagtgtttccagcattgcaaagttctgttggatagcactgtttgccagatgttcccttctttgtgggtgaggactcttttggtgtgacttccctctgtattgaggctcttgttcctcagtatggggctgtttctgtctttacagtaagtgactactccagggttccctgccctgcacacgtagagtgggagcggcccgtggatcccagggaactgtgcttttcattgtaggccccctccctggaggggaagagggcaatctccgctggtatctcagaagtcttcttctgaggcataagcctctcttcccagggctcccctggtctcgctgtcaggccctaaggtatgtcttcccttggactaaagctccttggaactcccttttgacctcagtcttctctgggttccaggtaacttcctttaaaataaagacgctcctctcttgaagttttgggttcctgccctgatggtctatgtctccctgactctaaattaccaatccacttgctatgggattcctccatgagtgcagattggctccctcacagctgcggtacctttgcaccctcttatcttagtaagatttctgtcttctcccaggtctctcttgggtactgccttctgcccccaaatctctaagccttcttggtattagcttctttgggttaggagtgttatttccttttggtttaaggatcctgctctggaataaatgtcttggtggtttgagtcccttctacttggcattcagccctgtctgcatgagcgggttcagctcttcacagctttcggcatctctgctcgccgtcgttttcccccacccccaatctttcttctcctacctacagcttccacacacacacacacacacacacacacacacacacgcccttctctgtgagctgccagtttcatttgtctcctgacttgtctgagggatgacctctcctagccacctctgcccagcccctctgagtaggaagtgtgatttccagggctaatgcctccatcccagtcatcagctgtgtgcagcatgactgtcctgctctgaaaaacctttttgagtgtattctgggggaaggtactccatgctctaggaattttccacttcctgagtcagaggcacacaaaaaagtatgtaacttttcttgtttcaacaaacttatggggtcccctgttggccagacactatgctgggcagtcaagcgagcatcaggagaactggggctggtctcttgtcagatagcaaatgcttcttctctttaccagtcccacctacctcactatgctgactaggtccatgtctctgggtttttaccagccagggaatacgtgttaattcctctccaatctctcctagcagcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggcggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatgacggctggcagcagcggcctctcctgtacccc

SEQ ID NO: 280382 - DNA, 2361 bp, Homo sapiens
  misc_feature (2326)..(2326): n is a, c, g, or t
  misc_feature (2329)..(2329): n is a, c, g, or t
aaattctccctgggggtaaggtaccagccctgtcctttatgggcttcttgttctaaagcatatccgtcccatatggttgctgctagtcacatgtggtgattagtaactagttaaaaatgaaaaattcagttcctccattacacttgccacatttcagatgttcagtggccaacagatatgcgcaaatagagtgtttccagcattgcaaagttctgttggatagcactgtttgccagatgttcccttctttgtgggtgaggactcttttggtgtgacttccctctgtattgaggctcttgttcctcagtatggggctgtttctgtctttacagtaagtgactactccagggttccctgccctgcacacgtagagtgggagcggcccgtggatcccagggaactgtgcttttcattgtaggccccctccctggaggggaagagggcaatctccgctggtatctcagaagtcttcttctgaggcataagcctctcttcccagggctcccctggtctcgctgtcaggccctaaggtatgtcttcccttggactaaagctccttggaactcccttttgacctcagtcttctctgggttccaggtaacttcctttaaaataaagacgctcctctcttgaagttttgggttcctgccctgatggtctatgtctccctgactctaaattaccaatccacttgctatgggattcctccatgagtgcagattggctccctcacagctgcggtacctttgcaccctcttatcttagtaagatttctgtcttctcccaggtctctcttgggtactgccttctgcccccaaatctctaagccttcttggtattagcttctttgggttaggagtgttatttccttttggtttaaggatcctgctctggaataaatgtcttggtggtttgagtcccttctacttggcattcagccctgtctgcatgagcgggttcagctcttcacagctttcggcatctctgctcgccgtcgttttcccccacccccaatctttcttctcctacctacagcttccacacacacacacacacacacacacacacacacacgcccttctctgtgagctgccagtttcatttgtctcctgacttgtctgagggatgacctctcctagccacctctgcccagcccctctgagtaggaagtgtgatttccagggctaatgcctccatcccagtcatcagctgtgtgcagcatgactgtcctgctctgaaaaacctttttgagtgtattctgggggaaggtactccatgctctaggaattttccacttcctgagtcagaggcacacaaaaaagtatgtaacttttcttgtttcaacaaacttatggggtcccctgttggccagacactatgctgggcagtcaagcgagcatcaggagaactggggctggtctcttgtcagatagcaaatgcttcttctctttaccagtcccacctacctcactatgctgactaggtccatgtctctgggtttttaccagccagggaatacgtgttaattcctctccaatctctcctagcagcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctcnccncccagccgtcagtgaagccgtcgtagcagtga

SEQ ID NO: 280383 - DNA, 908 bp, Homo sapiens
tgctgttcagtgtatacgacggcattgcatcgctgatcagtggtcttagcgtttccagatgtcccacgacagtcccggcatcaataaaatgtccctgcagagtgcttggatttagactctgagactgttccattctctagaacaagggtgacagtacccactgcctcgaggtctttgtgaagattaaatgctaggctgtgcatcctgtactcacgtgagaggtgctcaaaagccacagccctcgaggaaacgaaggctgtgcactcacacctggggctggggccccgtctctggcagctggcttcggtggaacctctgcggccccctccgtttcctcctcgctgaagtggcatgataacatttcctacccaagaagaaccttgtgaggatggatgagagtgtgtgcgtgcagggcagctggcccggttgcctgacacatccacagccctaagaattgtcccctttgtctgttggtccggcccagatcccagaccacctcctcgtccactcactgaccgccttctcccccggccagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatga

SEQ ID NO: 280384 - DNA, 2004 bp, Homo sapiens
aaattctccctgggggtaaggtaccagccctgtcctttatgggcttcttgttctaaagcatatccgtcccatatggttgctgctagtcacatgtggtgattagtaactagttaaaaatgaaaaattcagttcctccattacacttgccacatttcagatgttcagtggccaacagatatgcgcaaatagagtgtttccagcattgcaaagttctgttggatagcactgtttgccagatgttcccttctttgtgggtgaggactcttttggtgtgacttccctctgtattgaggctcttgttcctcagtatggggctgtttctgtctttacagtaagtgactactccagggttccctgccctgcacacgtagagtgggagcggcccgtggatcccagggaactgtgcttttcattgtaggccccctccctggaggggaagagggcaatctccgctggtatctcagaagtcttcttctgaggcataagcctctcttcccagggctcccctggtctcgctgtcaggccctaaggtatgtcttcccttggactaaagctccttggaactcccttttgacctcagtcttctctgggttccaggtaacttcctttaaaataaagacgctcctctcttgaagttttgggttcctgccctgatggtctatgtctccctgactctaaattaccaatccacttgctatgggattcctccatgagtgcagattggctccctcacagctgcggtacctttgcaccctcttatcttagtaagatttctgtcttctcccaggtctctcttgggtactgccttctgcccccaaatctctaagccttcttggtattagcttctttgggttaggagtgttatttccttttggtttaaggatcctgctctggaataaatgtcttggtggtttgagtcccttctacttggcattcagccctgtctgcatgagcgggttcagctcttcacagctttcggcatctctgctcgccgtcgttttcccccacccccaatctttcttctcctacctacagcttccacacacacacacacacacacacacacacacacacgcccttctctgtgagctgccagtttcatttgtctcctgacttgtctgagggatgacctctcctagccacctctgcccagcccctctgagtaggaagtgtgatttccagggctaatgcctccatcccagtcatcagctgtgtgcagcatgactgtcctgctctgaaaaacctttttgagtgtattctgggggaaggtactccatgctctaggaattttccacttcctgagtcagaggcacacaaaaaagtatgtaacttttcttgtttcaacaaacttatggggtcccctgttggccagacactatgctgggcagtcaagcgagcatcaggagaactggggctggtctcttgtcagatagcaaatgcttcttctctttaccagtcccacctacctcactatgctgactaggtccatgtctctgggtttttaccagccagggaatacgtgttaattcctctccaatctctcctagcagcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaaggtacaggggctgagaccctaataatctgggtcttcagagaggagggcacaggaaggcggctcaggacctctgggtgttgaccagcgggaggggctacatatgcagatgctgaggacctaagagaatcagctctaagatggattgggggtaggggttggggggggtcctcgagtccctagcataaggaagaatcactggagtgggtactgggacatcccctcccacactgacttctcaattctctccatccctcagctccacaatgcagccaacaaccgacttaatcaccacccaacaatgacttattcaaa

SEQ ID NO: 280385 - DNA, 359 bp, Homo sapiens
gagagtatgaagagagtgcgtctgtagggcagggaagatggcggacaagcgcaaactccaaggtactagactgacttcctgctgcacctgtagccacatgctccctcttctgaggactgctctttagatacctgccacctgggcaggattctcacagccttgttcctccctggccaggtgagattgatcgctgcctcaagaaggtgtccgagggcgtggagcagtttgaagatatttggcagaaggtacaggggctgagaccctaataatctgggtcttcagagaggagggcacaggaaggcggctcaggacctctgggtgttgaccagcgggaggggctacatatgcagatgctgagg

SEQ ID NO: 280386 - DNA, 418 bp, Homo sapiens
cggctgagggaccaaatcaagacatgggtagcgtccaacgagatcaaggacaagaggcagcttatagacaaccgcaagctcattgagacggtaggagcccagagcctgagtcccagagaggtgggaaggtcaccagattcttgagatcccaaggggcggaggcagagcggccagaccccagaggtcctcaagagaagtaaggtttctgcacctaagggaagtgaagaggcagcggactcagagctcagaaagtagggtcacgaggctcaggtcggagtgtctgctggcccttagtcagctcctttcccacctttgagagcccccctgccaactgcactctctacagcaaatggaacggttcaaagttgtggaacgagagaccaaaaccaaagcttacagcaaagagggcctgggcctg

SEQ ID NO: 280387 - DNA, 383 bp, Homo sapiens
ccactgaggcacacctcagccccgcttccagttgcccactggctcacccgcggcccctccccagccctgctccagcagccccagtctaggccgaccccactctgctcatcggcacattctcaggcctccctggagaccactggggagctgtccagccccctcccaaccccagtgagtcatgagtgacctccaccctcatccccacttgggaaattttctaaattgcctcctctctcagctctcatcacacattagtttttcttccttctcaaagcttctctgaaagcaattttcacctcctgtctcattttccttctcctgatcagcattggtatgttctgtgcccccagccccatctccaagaggattgtccagcccaactg

SEQ ID NO: 280388 - DNA, 4136 bp, Homo sapiens
aaattctccctgggggtaaggtaccagccctgtcctttatgggcttcttgttctaaagcatatccgtcccatatggttgctgctagtcacatgtggtgattagtaactagttaaaaatgaaaaattcagttcctccattacacttgccacatttcagatgttcagtggccaacagatatgcgcaaatagagtgtttccagcattgcaaagttctgttggatagcactgtttgccagatgttcccttctttgtgggtgaggactcttttggtgtgacttccctctgtattgaggctcttgttcctcagtatggggctgtttctgtctttacagtaagtgactactccagggttccctgccctgcacacgtagagtgggagcggcccgtggatcccagggaactgtgcttttcattgtaggccccctccctggaggggaagagggcaatctccgctggtatctcagaagtcttcttctgaggcataagcctctcttcccagggctcccctggtctcgctgtcaggccctaaggtatgtcttcccttggactaaagctccttggaactcccttttgacctcagtcttctctgggttccaggtaacttcctttaaaataaagacgctcctctcttgaagttttgggttcctgccctgatggtctatgtctccctgactctaaattaccaatccacttgctatgggattcctccatgagtgcagattggctccctcacagctgcggtacctttgcaccctcttatcttagtaagatttctgtcttctcccaggtctctcttgggtactgccttctgcccccaaatctctaagccttcttggtattagcttctttgggttaggagtgttatttccttttggtttaaggatcctgctctggaataaatgtcttggtggtttgagtcccttctacttggcattcagccctgtctgcatgagcgggttcagctcttcacagctttcggcatctctgctcgccgtcgttttcccccacccccaatctttcttctcctacctacagcttccacacacacacacacacacacacacacacacacacgcccttctctgtgagctgccagtttcatttgtctcctgacttgtctgagggatgacctctcctagccacctctgcccagcccctctgagtaggaagtgtgatttccagggctaatgcctccatcccagtcatcagctgtgtgcagcatgactgtcctgctctgaaaaacctttttgagtgtattctgggggaaggtactccatgctctaggaattttccacttcctgagtcagaggcacacaaaaaagtatgtaacttttcttgtttcaacaaacttatggggtcccctgttggccagacactatgctgggcagtcaagcgagcatcaggagaactggggctggtctcttgtcagatagcaaatgcttcttctctttaccagtcccacctacctcactatgctgactaggtccatgtctctgggtttttaccagccagggaatacgtgttaattcctctccaatctctcctagcagcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggcggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatga

SEQ ID NO: 280389 - DNA, 5687 bp, Homo sapiens
  misc_feature (3638)..(3640): n is a, c, g, or t
  misc_feature (4146)..(4146): n is a, c, g, or t
  misc_feature (4626)..(4626): n is a, c, g, or t
  misc_feature (4647)..(4647): n is a, c, g, or t
aaattctccctgggggtaaggtaccagccctgtcctttatgggcttcttgttctaaagcatatccgtcccatatggttgctgctagtcacatgtggtgattagtaactagttaaaaatgaaaaattcagttcctccattacacttgccacatttcagatgttcagtggccaacagatatgcgcaaatagagtgtttccagcattgcaaagttctgttggatagcactgtttgccagatgttcccttctttgtgggtgaggactcttttggtgtgacttccctctgtattgaggctcttgttcctcagtatggggctgtttctgtctttacagtaagtgactactccagggttccctgccctgcacacgtagagtgggagcggcccgtggatcccagggaactgtgcttttcattgtaggccccctccctggaggggaagagggcaatctccgctggtatctcagaagtcttcttctgaggcataagcctctcttcccagggctcccctggtctcgctgtcaggccctaaggtatgtcttcccttggactaaagctccttggaactcccttttgacctcagtcttctctgggttccaggtaacttcctttaaaataaagacgctcctctcttgaagttttgggttcctgccctgatggtctatgtctccctgactctaaattaccaatccacttgctatgggattcctccatgagtgcagattggctccctcacagctgcggtacctttgcaccctcttatcttagtaagatttctgtcttctcccaggtctctcttgggtactgccttctgcccccaaatctctaagccttcttggtattagcttctttgggttaggagtgttatttccttttggtttaaggatcctgctctggaataaatgtcttggtggtttgagtcccttctacttggcattcagccctgtctgcatgagcgggttcagctcttcacagctttcggcatctctgctcgccgtcgttttcccccacccccaatctttcttctcctacctacagcttccacacacacacacacacacacacacacacacacacgcccttctctgtgagctgccagtttcatttgtctcctgacttgtctgagggatgacctctcctagccacctctgcccagcccctctgagtaggaagtgtgatttccagggctaatgcctccatcccagtcatcagctgtgtgcagcatgactgtcctgctctgaaaaacctttttgagtgtattctgggggaaggtactccatgctctaggaattttccacttcctgagtcagaggcacacaaaaaagtatgtaacttttcttgtttcaacaaacttatggggtcccctgttggccagacactatgctgggcagtcaagcgagcatcaggagaactggggctggtctcttgtcagatagcaaatgcttcttctctttaccagtcccacctacctcactatgctgactaggtccatgtctctgggtttttaccagccagggaatacgtgttaattcctctccaatctctcctagcagcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggcggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagnnncagcagggcccccggggcagcctcgggccccccggcttcgccgccaccgccgccgtcccccctcgggctggaggggtgagggcactaaggcacagtatctggcagccaaggccctaaagaagcagtcatggcgattccacaccaagtacatgatgtggttccagaggcacgaggagcccaagaccatcactgacgagtttgagcaggtgagggccccgccccctctcttcccgctgctagggttggggtagagtccccaggctccaggcagcccctgctggcctctgctcccttgcctccacctttcagctggcgcagtccctcagcctgaccaagtactcctccctctggctgtctgctcagcctggaacaccgccctctcatcctccacttggccagctcctaggcctcctgtaggtctcagcccaaatgtcccttcctcaaagaaaccttcctggagccacccagcccagtgcctcccctttgcagtgctgggcacactcgcntggggtgtgggattttcccagtatgtgtccctgcaccaggctgtgggctctgctgccgagggaccttgatggcccccacttcacctccaggtcccagcactcagcagggcaggggctcagtgccgaaactattttttttgaatgggcttctcaagttctaatactgggaaattcctgctgcttgcaaacactctggaaccaacctacctgggtttcagcccagtccagctgggcgactctaggcaagtcactcgaacctctgtgtctcaattaacttatctgtaaaatggggggagacacctacctaatgcagttgttatgaagattaaatgagttaataacatgtaagtacttaatggtgactgctacatagtcagtgtcatggattttttttttcaaattactttcagttggtgtgttctacagtgatgtttttttccaccaaatacttccctgatgccgagccccttcatggggatnaagtagtacaaggtccttgtnctcagagaactcagtcccctctcctggttctcccaggttgccatctttgaagcacttaagacattcatttagaacctaggtcctctcccattgtgtcctcagatgttaaccacagacttcctgtcctttcctggtttggcccaaaaccatcctccaagttagtacatttcagggcatccagtcattcagaaattcccacaccacttccgtcaccaataaaatgtccctgcagagtgcttggatttagactctgagactgttccattctctagaacaagggtgacagtacccactgcctcgaggtctttgtgaagattaaatgctaggctgtgcatcctgtactcacgtgagaggtgctcaaaagccacagccctcgaggaaacgaaggctgtgcactcacacctggggctggggccccgtctctggcagctggcttcggtggaacctctgcggccccctccgtttcctcctcgctgaagtggcatgataacatttcctacccaagaagaaccttgtgaggatggatgagagtgtgtgcgtgcagggcagctggcccggttgcctgacacatccacagccctaagaattgtcccctttgtctgttggtccggcccagatcccagaccacctcctcgtccactcactgaccgccttctcccccggccagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatga

SEQ ID NO: 280390 - DNA, 4654 bp, Homo sapiens
aaattctccctgggggtaaggtaccagccctgtcctttatgggcttcttgttctaaagcatatccgtcccatatggttgctgctagtcacatgtggtgattagtaactagttaaaaatgaaaaattcagttcctccattacacttgccacatttcagatgttcagtggccaacagatatgcgcaaatagagtgtttccagcattgcaaagttctgttggatagcactgtttgccagatgttcccttctttgtgggtgaggactcttttggtgtgacttccctctgtattgaggctcttgttcctcagtatggggctgtttctgtctttacagtaagtgactactccagggttccctgccctgcacacgtagagtgggagcggcccgtggatcccagggaactgtgcttttcattgtaggccccctccctggaggggaagagggcaatctccgctggtatctcagaagtcttcttctgaggcataagcctctcttcccagggctcccctggtctcgctgtcaggccctaaggtatgtcttcccttggactaaagctccttggaactcccttttgacctcagtcttctctgggttccaggtaacttcctttaaaataaagacgctcctctcttgaagttttgggttcctgccctgatggtctatgtctccctgactctaaattaccaatccacttgctatgggattcctccatgagtgcagattggctccctcacagctgcggtacctttgcaccctcttatcttagtaagatttctgtcttctcccaggtctctcttgggtactgccttctgcccccaaatctctaagccttcttggtattagcttctttgggttaggagtgttatttccttttggtttaaggatcctgctctggaataaatgtcttggtggtttgagtcccttctacttggcattcagccctgtctgcatgagcgggttcagctcttcacagctttcggcatctctgctcgccgtcgttttcccccacccccaatctttcttctcctacctacagcttccacacacacacacacacacacacacacacacacacgcccttctctgtgagctgccagtttcatttgtctcctgacttgtctgagggatgacctctcctagccacctctgcccagcccctctgagtaggaagtgtgatttccagggctaatgcctccatcccagtcatcagctgtgtgcagcatgactgtcctgctctgaaaaacctttttgagtgtattctgggggaaggtactccatgctctaggaattttccacttcctgagtcagaggcacacaaaaaagtatgtaacttttcttgtttcaacaaacttatggggtcccctgttggccagacactatgctgggcagtcaagcgagcatcaggagaactggggctggtctcttgtcagatagcaaatgcttcttctctttaccagtcccacctacctcactatgctgactaggtccatgtctctgggtttttaccagccagggaatacgtgttaattcctctccaatctctcctagcagcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggatgaggggccaagcaggtgctctgcagcccctgagcctggccctgggctcgccagcagaagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggcggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagcccagagatgttagaactgcttgggttgacagcgaggctggtccactgaggcacacctcagccccgcttccagttgcccactggctcacccgcggcccctccccagccctgctccagcagccccagtctaggccgaccccactctgctcatcggcacattctcaggcctccctggagaccactggggagctgtccagccccctcccaaccccacttctctgaaagcaattttcacctcctgtctcattttccttctcctgatcagcattggtatgttctgtgcccccagccccatctccaagaggattgtccagcccaactgtggtctgtggcgggggccggggttcagccctgatgtcctgccccattcccctggctccccacccagtttgggggccccctgatccccctctccactgttcctcccccagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatgacggctggcagcagcggcctctcctgtacccc

SEQ ID NO: 280391 - DNA, 5403 bp, Homo sapiens
  misc_feature (3354)..(3356): n is a, c, g, or t
  misc_feature (3862)..(3862): n is a, c, g, or t
  misc_feature (4342)..(4342): n is a, c, g, or t
  misc_feature (4363)..(4363): n is a, c, g, or t
aaattctccctgggggtaaggtaccagccctgtcctttatgggcttcttgttctaaagcatatccgtcccatatggttgctgctagtcacatgtggtgattagtaactagttaaaaatgaaaaattcagttcctccattacacttgccacatttcagatgttcagtggccaacagatatgcgcaaatagagtgtttccagcattgcaaagttctgttggatagcactgtttgccagatgttcccttctttgtgggtgaggactcttttggtgtgacttccctctgtattgaggctcttgttcctcagtatggggctgtttctgtctttacagtaagtgactactccagggttccctgccctgcacacgtagagtgggagcggcccgtggatcccagggaactgtgcttttcattgtaggccccctccctggaggggaagagggcaatctccgctggtatctcagaagtcttcttctgaggcataagcctctcttcccagggctcccctggtctcgctgtcaggccctaaggtatgtcttcccttggactaaagctccttggaactcccttttgacctcagtcttctctgggttccaggtaacttcctttaaaataaagacgctcctctcttgaagttttgggttcctgccctgatggtctatgtctccctgactctaaattaccaatccacttgctatgggattcctccatgagtgcagattggctccctcacagctgcggtacctttgcaccctcttatcttagtaagatttctgtcttctcccaggtctctcttgggtactgccttctgcccccaaatctctaagccttcttggtattagcttctttgggttaggagtgttatttccttttggtttaaggatcctgctctggaataaatgtcttggtggtttgagtcccttctacttggcattcagccctgtctgcatgagcgggttcagctcttcacagctttcggcatctctgctcgccgtcgttttcccccacccccaatctttcttctcctacctacagcttccacacacacacacacacacacacacacacacacacgcccttctctgtgagctgccagtttcatttgtctcctgacttgtctgagggatgacctctcctagccacctctgcccagcccctctgagtaggaagtgtgatttccagggctaatgcctccatcccagtcatcagctgtgtgcagcatgactgtcctgctctgaaaaacctttttgagtgtattctgggggaaggtactccatgctctaggaattttccacttcctgagtcagaggcacacaaaaaagtatgtaacttttcttgtttcaacaaacttatggggtcccctgttggccagacactatgctgggcagtcaagcgagcatcaggagaactggggctggtctcttgtcagatagcaaatgcttcttctctttaccagtcccacctacctcactatgctgactaggtccatgtctctgggtttttaccagccagggaatacgtgttaattcctctccaatctctcctagcagcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggcggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagnnncagcagggcccccggggcagcctcgggccccccggcttcgccgccaccgccgccgtcccccctcgggctggaggggtgagggcactaaggcacagtatctggcagccaaggccctaaagaagcagtcatggcgattccacaccaagtacatgatgtggttccagaggcacgaggagcccaagaccatcactgacgagtttgagcaggtgagggccccgccccctctcttcccgctgctagggttggggtagagtccccaggctccaggcagcccctgctggcctctgctcccttgcctccacctttcagctggcgcagtccctcagcctgaccaagtactcctccctctggctgtctgctcagcctggaacaccgccctctcatcctccacttggccagctcctaggcctcctgtaggtctcagcccaaatgtcccttcctcaaagaaaccttcctggagccacccagcccagtgcctcccctttgcagtgctgggcacactcgcntggggtgtgggattttcccagtatgtgtccctgcaccaggctgtgggctctgctgccgagggaccttgatggcccccacttcacctccaggtcccagcactcagcagggcaggggctcagtgccgaaactattttttttgaatgggcttctcaagttctaatactgggaaattcctgctgcttgcaaacactctggaaccaacctacctgggtttcagcccagtccagctgggcgactctaggcaagtcactcgaacctctgtgtctcaattaacttatctgtaaaatggggggagacacctacctaatgcagttgttatgaagattaaatgagttaataacatgtaagtacttaatggtgactgctacatagtcagtgtcatggattttttttttcaaattactttcagttggtgtgttctacagtgatgtttttttccaccaaatacttccctgatgccgagccccttcatggggatnaagtagtacaaggtccttgtnctcagagaactcagtcccctctcctggttctcccaggttgccatctttgaagcacttaagacattcatttagaacctaggtcctctcccattgtgtcctcagatgttaaccacagacttcctgtcctttcctggtttggcccaaaaccatcctccaagttagtacatttcagggcatccagtcattcagaaattcccacaccacttccgtcaccaataaaatgtccctgcagagtgcttggatttagactctgagactgttccattctctagaacaagggtgacagtacccactgcctcgaggtctttgtgaagattaaatgctaggctgtgcatcctgtactcacgtgagaggtgctcaaaagccacagccctcgaggaaacgaaggctgtgcactcacacctggggctggggccccgtctctggcagctggcttcggtggaacctctgcggccccctccgtttcctcctcgctgaagtggcatgataacatttcctacccaagaagaaccttgtgaggatggatgagagtgtgtgcgtgcagggcagctggcccggttgcctgacacatccacagccctaagaattgtcccctttgtctgttggtccggcccagatcccagaccacctcctcgtccactcactgaccgccttctcccccggccagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatga

SEQ ID NO: 280392 - DNA, 2371 bp, Homo sapiens
aaattctccctgggggtaaggtaccagccctgtcctttatgggcttcttgttctaaagcatatccgtcccatatggttgctgctagtcacatgtggtgattagtaactagttaaaaatgaaaaattcagttcctccattacacttgccacatttcagatgttcagtggccaacagatatgcgcaaatagagtgtttccagcattgcaaagttctgttggatagcactgtttgccagatgttcccttctttgtgggtgaggactcttttggtgtgacttccctctgtattgaggctcttgttcctcagtatggggctgtttctgtctttacagtaagtgactactccagggttccctgccctgcacacgtagagtgggagcggcccgtggatcccagggaactgtgcttttcattgtaggccccctccctggaggggaagagggcaatctccgctggtatctcagaagtcttcttctgaggcataagcctctcttcccagggctcccctggtctcgctgtcaggccctaaggtatgtcttcccttggactaaagctccttggaactcccttttgacctcagtcttctctgggttccaggtaacttcctttaaaataaagacgctcctctcttgaagttttgggttcctgccctgatggtctatgtctccctgactctaaattaccaatccacttgctatgggattcctccatgagtgcagattggctccctcacagctgcggtacctttgcaccctcttatcttagtaagatttctgtcttctcccaggtctctcttgggtactgccttctgcccccaaatctctaagccttcttggtattagcttctttgggttaggagtgttatttccttttggtttaaggatcctgctctggaataaatgtcttggtggtttgagtcccttctacttggcattcagccctgtctgcatgagcgggttcagctcttcacagctttcggcatctctgctcgccgtcgttttcccccacccccaatctttcttctcctacctacagcttccacacacacacacacacacacacacacacacacacgcccttctctgtgagctgccagtttcatttgtctcctgacttgtctgagggatgacctctcctagccacctctgcccagcccctctgagtaggaagtgtgatttccagggctaatgcctccatcccagtcatcagctgtgtgcagcatgactgtcctgctctgaaaaacctttttgagtgtattctgggggaaggtactccatgctctaggaattttccacttcctgagtcagaggcacacaaaaaagtatgtaacttttcttgtttcaacaaacttatggggtcccctgttggccagacactatgctgggcagtcaagcgagcatcaggagaactggggctggtctcttgtcagatagcaaatgcttcttctctttaccagtcccacctacctcactatgctgactaggtccatgtctctgggtttttaccagccagggaatacgtgttaattcctctccaatctctcctagcagcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctcctcccctccccagtgagggacattttttggtaaacctattttcattttggaaaatatttatgaataaatagttttatatga

SEQ ID NO: 280393 - DNA, 492 bp, Homo sapiens
ctgtcccaaggaccttgaatttatttttcacataagacaacccagaacaagaattgctcaggtatcatatctggccaaagtacataacagatttaaagttttaaaaagaagcaaggtctgataagaattaagttttgaaaaatcttattaacaacaggctaaggtgcctttgagttgggtggttctaccagaccccagaatggtgctctgctatacaattgacctttcttagtttccagaatagggaagctagagctgagcaagacttaaccactaattactattatctgacccaggaaaactccgcctttccagttgtataatttataacaatagtgcctaaaagattaaatcaataggtacatacttcatcaaatttgttcaggttgttggaaaggagactaacaagttgtccaatacttattttatctagaacacggcttgacagctttaaagtctaaaagaaaaatggaaagttagataatttcaaca

SEQ ID NO: 280394 - DNA, 801 bp, Homo sapiens
ttttagtagagacagggtttcaccatcttggccaagctggtctcgaactgacctcgtgatccacccaaagtactgggcctcccaaagtactgggattacaggcgtgagacaccgcgcccggccgactcaattctatttttaaaaatattaggagattacatagctttgatcagtgtaaaacattcccagttctcaccatcaacaactctggccaggaggatttttctttctgacatatatctaagctctcaaatgttgcaactcgttagaattccatcaaatatcagatctgttgattaacaaattcctgcagttttctgcaaatgtccctcctacttgcaaagaagacgtccattttggccaagtagacagtaagaaataaggattaacaggtgaggtcaggatgtgtctcgtgttccagactttaggtgagctcagcctgagggcttattccctttccttggaggaacacaggatgttagttgaaaatccagtctatatgcaatagtcagtcccatccgaaacagactggacttggccttggacttcccagagccatgctctcttactgtcccttgtggcctctctcattctactcaggtaaggtcgggtttgaagctacgtttatggaaatgcaatgcgtgccactcaaaaaccctccagtccataagctgggacttctgccccgttccctttttccaggggcttcccttcaaacagcagtgagtctctatggggaatccctgcatctccctctctcttgtcttcccagggtcgacgcggccgcgaatttagtagtag

SEQ ID NO: 280395 - DNA, 5159 bp, Homo sapiens
  misc_feature (686)..(686): n is a, c, g, or t
  misc_feature (2672)..(2672): n is a, c, g, or t
ggcacgaggcgcaggatgagggcggccattgctggggctccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagatngtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttggcaccagtttgtagaaaataatttaatactaaagatgggcccagtggataagcggaagggtttatttgcaagacgacgacagctgttgctcacagaaggaccacatttatattatgtggatcctgtcaacaaagttctgaaaggtgaaattccttggtcacaagaacttcgaccagaggccaagaattttaaaactttctttgtccacacgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttatttaaaagaaaagaagaaaaaaaacacccaaccacacaaagaacaaaaccagtaacaaacacaaaggaattcagggtcgctttgcttgctctctgtgctccgtggaggcctccgtgtgccctcgttgccgtggggacccagctccatgcacgtcaacccagtcccgcccagactagtggacagacctggtgtcaccagtttttcctagcatcagtccgaaccatgcgcccgccctgccccaactgtgtgctggtcctgctgtggccgaggggaccgggtgtgtttggctctttatgcccctcccgctgtggtcctggaactcttcaccagggagggagccctgcgggggccgcagctttgtggagggagccgccgtgcttctgtcacctgctccctttcttgcgtctccctgtgatgggcccttaggcctggctgggcccattacatatccctgtggtggctctggtggcagctttctgtggcccctgctgtgttggcaggcaggtttgcgtggtgaggagcgggaggggttggagtggtgcgggagcaggctgccgagtggagggtgccatcgagggctccggatcccttatcctacttagcagtgttggtctctggggctgaagccgagcgcatgctgggagcggtactgtcagaagtgagcccagttagtaccccgctggctcactgcacgagagagtcctgccccgagccctaggtggggccaggaggtgccttggagaanccagccagagcagagagggctgctgacttccgtgtggagcagagaggcctgagggcctcctaaaaggtttaaatgtccacgcctctccagttgctgaagtagggtctgagagaaccctggcatcagcagacccagggtgcttctgtctcctgcagaccacgccagggagtgcagacaccaccgtcacacacgccccttttgtgttttggttcaagtttctcagagcccctcagagcttctacatctgtgcatcagaaatctcacagccttctcatgctgccggctcatctgggcccatagagtgggctttgccagttgctgttgcacaggaggcgagaacagcacacttcaaccccagcttgctggtcggctttcctctagagagagccggttttggggccatttccctttgatgctttggtggccttgccccgctctgcagcacagacaggccagatgcatttgtcctttgcctagctactccccaggtagagagtgctcctggtggcctggcaggtctgggcccttctctccctgcccaggttgtccctggagggcagccctcactccctttgggggagaggcagacattgctgcccacagacctgcctctgactcaactgtgtccaccctccctggtccctacccccaagtcacaggtgactcagcagtgaccctgtgtgccaggccagatccaaactgagagggaaggtgtcgtttttacactgctaatgacgagagtggctctttttagctaggcgagtacagacggggcctgggagggggcagagatgttccccaggccctgcctgtggttcctgcctgggccttggctgctgctgtgtgagagctgcatgtgagcctgtgaccgtgagctggggtgagctgggccgcacctaccctggggccccagggagcaggacgctccggggcccagcacgttgccctgggcctgtggccggagtcggagtcctctctcctcctcctggcttttggaaaggcttggctgtgttggggagtctctcttagccctttcaggaatttctgttcaggcttcctcctcctcatcagctattttacccatctcagaacgtcctgtgtctccatgtaggagagtggctctctcagatctctcagggcgtctggttatagggaaacaagtggagcagggacgtggctttaattggagcactcggctgggctgcttggggagactcttccgtgcgttcttcctctggatagaaccaccacctcctgggcgtcactgacaagctccatcttaacctccaaagccacagaactaggggctcagagccagagctggcagccgccagccaaaatgatgccattgcctgagctgacagccaagcccttctgtgggtcacctttctcctcacccagccccttgctcttcccttttgaaaggcccgtgtgttttctttccttaccctgtgcttgctcatgtctactccggttttctctaccacatccttagagccatcacctggcacgcaggcgccttacattctacggtagaacgtggggtactgtgtgtgcacatagacacacttacgtggaattacagttgtgggtttatccaagatgaggaagatttcacctgctgtttaatagacttggggccatgtgcctccccacacatgggcaaggacaggtggaatgtcgggaccacactgtgcggcttctcggcacaaagcggagggaggctgtggtcgctgccggcctaggtgtcccaggtgccccgcctttctctgggacacagttgggggctggcttctgagggattcctttctcccctctttgtgtggccccagccagggcggtgggcagtcctggtgtcgtcgatataagtttatttaactgtagttcgtatcgtttccggcttctatgtggttttatttttgttgttggcttgttaacaattgttttgagagagatggctggtcatgccacagctgctggggactccgcctactccagccctcttgggacacactgtgggatttgtggcccttccccagaggaattgtggagactgtcccatggaacaaaccctcaggcaccagcacagggctctgggtgactcagtaaaactaacgtttgtctctgacaagatcagctgtaggctcaccggccagagaagaccactgtgagcattttgccgtatatcctgccctgccatttgttcactttttaaactaaaataggaacatccgacacacaccgtttgcatcgtcttctcccttgatattttaagcattttcccatgtcatgagtttctcagaaacatgtttttaacaattgtactatttagtcattgtccatttactataatttatctgaccatttccctactgtaaaatacttaagacggtttctgatttttccactatttaaataatgctgtgatgaatatctttaaaatcttctgatttcttacttttttcccccttagatgcctggaagtgg

SEQ ID NO: 280396 - DNA, 2206 bp, Homo sapiens
  misc_feature (686)..(686): n is a, c, g, or t
ggcacgaggcgcaggatgagggcggccattgctggggctccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagatngtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttggcaccagtttgtagaaaataatttaatactaaagatgggcccagtggataagcggaagggtttatttgcaagacgacgacagctgttgctcacagaaggaccacatttatattatgtggatcctgtcaacaaagttctgaaaggtgaaattccttggtcacaagaacttcgaccagaggccaagaattttaaaactttctttgtccacacgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttatttaaaagaaaagaagaaaaaaaacacccaaccacacaaagaacaaaaccagtaacaaacacaaaggaattcagggtcgctttgcttgctctctgtgctccgtggaggcctccgtgtgccctcgttgccgtggggacccagctccatgcacgtcaacccagtcccgcccagactagtggacagacctggtgtcaccagtttttcctagcatcagtccgaaccatgcgcccgccctgcccttcagggaaatgggggtcattaaaggaaactgaaccttga

SEQ ID NO: 280397 - DNA, 5162 bp, Homo sapiens
  misc_feature (686)..(686): n is a, c, g, or t
  misc_feature (2672)..(2672): n is a, c, g, or t
ggcacgaggcgcaggatgagggcggccattgctggggctccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagatngtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttggcaccagtttgtagaaaataatttaatactaaagatgggcccagtggataagcggaagggtttatttgcaagacgacgacagctgttgctcacagaaggaccacatttatattatgtggatcctgtcaacaaagttctgaaaggtgaaattccttggtcacaagaacttcgaccagaggccaagaattttaaaactttctttgtccacacgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttatttaaaagaaaagaagaaaaaaaacacccaaccacacaaagaacaaaaccagtaacaaacacaaaggaattcagggtcgctttgcttgctctctgtgctccgtggaggcctccgtgtgccctcgttgccgtggggacccagctccatgcacgtcaacccagtcccgcccagactagtggacagacctggtgtcaccagtttttcctagcatcagtccgaaccatgcgcccgccctgccccaactgtgtgctggtcctgctgtggccgaggggaccgggtgtgtttggctctttatgcccctcccgctgtggtcctggaactcttcaccagggagggagccctgcgggggccgcagctttgtggagggagccgccgtgcttctgtcacctgctccctttcttgcgtctccctgtgatgggcccttaggcctggctgggcccattacatatccctgtggtggctctggtggcagctttctgtggcccctgctgtgttggcaggcaggtttgcgtggtgaggagcgggaggggttggagtggtgcgggagcaggctgccgagtggagggtgccatcgagggctccggatcccttatcctacttagcagtgttggtctctggggctgaagccgagcgcatgctgggagcggtactgtcagaagtgagcccagttagtaccccgctggctcactgcacgagagagtcctgccccgagccctaggtggggccaggaggtgccttggagaanccagccagagcagagagggctgctgacttccgtgtggagcagagaggcctgagggcctcctaaaaggtttaaatgtccacgcctctccagttgctgaagtagggtctgagagaaccctggcatcagcagacccagggtgcttctgtctcctgcagaccacgccagggagtgcagacaccaccgtcacacacgccccttttgtgttttggttcaagtttctcagagcccctcagagcttctacatctgtgcatcagaaatctcacagccttctcatgctgccggctcatctgggcccatagagtgggctttgccagttgctgttgcacaggaggcgagaacagcacacttcaaccccagcttgctggtcggctttcctctagagagagccggttttggggccatttccctttgatgctttggtggccttgccccgctctgcagcacagacaggccagatgcatttgtcctttgcctagctactccccaggtagagagtgctcctggtggcctggcaggtctgggcccttctctccctgcccaggttgtccctggagggcagccctcactccctttgggggagaggcagacattgctgcccacagacctgcctctgactcaactgtgtccaccctccctggtccctacccccaagtcacaggtgactcagcagtgaccctgtgtgccaggccagatccaaactgagagggaaggtgtcgtttttacactgctaatgacgagagtggctctttttagctaggcgagtacagacggggcctgggagggggcagagatgttccccaggccctgcctgtggttcctgcctgggccttggctgctgctgtgtgagagctgcatgtgagcctgtgaccgtgagctggggtgagctgggccgcacctaccctggggccccagggagcaggacgctccggggcccagcacgttgccctgggcctgtggccggagtcggagtcctctctcctcctcctggcttttggaaaggcttggctgtgttggggagtctctcttagccctttcaggaatttctgttcaggcttcctcctcctcatcagctattttacccatctcagaacgtcctgtgtctccatgtaggagagtggctctctcagatctctcagggcgtctggttatagggaaacaagtggagcagggacgtggctttaattggagcactcggctgggctgcttggggagactcttccgtgcgttcttcctctggatagaaccaccacctcctgggcgtcactgacaagctccatcttaacctccaaagccacagaactaggggctcagagccagagctggcagccgccagccaaaatgatgccattgcctgagctgacagccaagcccttctgtgggtcacctttctcctcacccagccccttgctcttcccttttgaaaggcccgtgtgttttctttccttaccctgtgcttgctcatgtctactccggttttctctaccacatccttagagccatcacctggcacgcaggcgccttacattctacggtagaacgtggggtactgtgtgtgcacatagacacacttacgtggaattacagttgtgggtttatccaagatgaggaagatttcacctgctgtttaatagacttggggccatgtgcctccccacacatgggcaaggacaggtggaatgtcgggaccacactgtgcggcttctcggcacaaagcggagggaggctgtggtcgctgccggcctaggtgtcccaggtgccccgcctttctctgggacacagttgggggctggcttctgagggattcctttctcccctctttgtgtggccccagccagggcggtgggcagtcctggtgtagagcacaagcctctccaccctagagaaatgcctctgtaccacggctaccatgtggaaccttaacttgcagaaggcttgttaacaattgttttgagagagatggctggtcatgccacagctgctggggactccgcctactccagccctcttgggacacactgtgggatttgtggcccttccccagaggaattgtggagactgtcccatggaacaaaccctcaggcaccagcacagggctctgggtgactcagtaaaactaacgtttgtctctgacaagatcagctgtaggctcaccggccagagaagaccactgtgagcattttgccgtatatcctgccctgccatttgttcactttttaaactaaaataggaacatccgacacacaccgtttgcatcgtcttctcccttgatattttaagcattttcccatgtcatgagtttctcagaaacatgtttttaacaattgtactatttagtcattgtccatttactataatttatctgaccatttccctactgtaaaatacttaagacggtttctgatttttccactatttaaataatgctgtgatgaatatctttaaaatcttctgatttcttacttttttcccccttagatgcctggaagtgg

SEQ ID NO: 280398 - DNA, 4781 bp, Homo sapiens
  misc_feature (2291)..(2291): n is a, c, g, or t
ggcacgaggcgcaggatgagggcggccattgctggggctccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgaccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttggcaccagtttgtagaaaataatttaatactaaagatgggcccagtggataagcggaagggtttatttgcaagacgacgacagctgttgctcacagaaggaccacatttatattatgtggatcctgtcaacaaagttctgaaaggtgaaattccttggtcacaagaacttcgaccagaggccaagaattttaaaactttctttgtccacacgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttatttaaaagaaaagaagaaaaaaaacacccaaccacacaaagaacaaaaccagtaacaaacacaaaggaattcagggtcgctttgcttgctctctgtgctccgtggaggcctccgtgtgccctcgttgccgtggggacccagctccatgcacgtcaacccagtcccgcccagactagtggacagacctggtgtcaccagtttttcctagcatcagtccgaaccatgcgcccgccctgccccaactgtgtgctggtcctgctgtggccgaggggaccgggtgtgtttggctctttatgcccctcccgctgtggtcctggaactcttcaccagggagggagccctgcgggggccgcagctttgtggagggagccgccgtgcttctgtcacctgctccctttcttgcgtctccctgtgatgggcccttaggcctggctgggcccattacatatccctgtggtggctctggtggcagctttctgtggcccctgctgtgttggcaggcaggtttgcgtggtgaggagcgggaggggttggagtggtgcgggagcaggctgccgagtggagggtgccatcgagggctccggatcccttatcctacttagcagtgttggtctctggggctgaagccgagcgcatgctgggagcggtactgtcagaagtgagcccagttagtaccccgctggctcactgcacgagagagtcctgccccgagccctaggtggggccaggaggtgccttggagaanccagccagagcagagagggctgctgacttccgtgtggagcagagaggcctgagggcctcctaaaaggtttaaatgtccacgcctctccagttgctgaagtagggtctgagagaaccctggcatcagcagacccagggtgcttctgtctcctgcagaccacgccagggagtgcagacaccaccgtcacacacgccccttttgtgttttggttcaagtttctcagagcccctcagagcttctacatctgtgcatcagaaatctcacagccttctcatgctgccggctcatctgggcccatagagtgggctttgccagttgctgttgcacaggaggcgagaacagcacacttcaaccccagcttgctggtcggctttcctctagagagagccggttttggggccatttccctttgatgctttggtggccttgccccgctctgcagcacagacaggccagatgcatttgtcctttgcctagctactccccaggtagagagtgctcctggtggcctggcaggtctgggcccttctctccctgcccaggttgtccctggagggcagccctcactccctttgggggagaggcagacattgctgcccacagacctgcctctgactcaactgtgtccaccctccctggtccctacccccaagtcacaggtgactcagcagtgaccctgtgtgccaggccagatccaaactgagagggaaggtgtcgtttttacactgctaatgacgagagtggctctttttagctaggcgagtacagacggggcctgggagggggcagagatgttccccaggccctgcctgtggttcctgcctgggccttggctgctgctgtgtgagagctgcatgtgagcctgtgaccgtgagctggggtgagctgggccgcacctaccctggggccccagggagcaggacgctccggggcccagcacgttgccctgggcctgtggccggagtcggagtcctctctcctcctcctggcttttggaaaggcttggctgtgttggggagtctctcttagccctttcaggaatttctgttcaggcttcctcctcctcatcagctattttacccatctcagaacgtcctgtgtctccatgtaggagagtggctctctcagatctctcagggcgtctggttatagggaaacaagtggagcagggacgtggctttaattggagcactcggctgggctgcttggggagactcttccgtgcgttcttcctctggatagaaccaccacctcctgggcgtcactgacaagctccatcttaacctccaaagccacagaactaggggctcagagccagagctggcagccgccagccaaaatgatgccattgcctgagctgacagccaagcccttctgtgggtcacctttctcctcacccagccccttgctcttcccttttgaaaggcccgtgtgttttctttccttaccctgtgcttgctcatgtctactccggttttctctaccacatccttagagccatcacctggcacgcaggcgccttacattctacggtagaacgtggggtactgtgtgtgcacatagacacacttacgtggaattacagttgtgggtttatccaagatgaggaagatttcacctgctgtttaatagacttggggccatgtgcctccccacacatgggcaaggacaggtggaatgtcgggaccacactgtgcggcttctcggcacaaagcggagggaggctgtggtcgctgccggcctaggtgtcccaggtgccccgcctttctctgggacacagttgggggctggcttctgagggattcctttctcccctctttgtgtggccccagccagggcggtgggcagtcctggtgtagagcacaagcctctccaccctagagaaatgcctctgtaccacggctaccatgtggaaccttaacttgcagaaggcttgttaacaattgttttgagagagatggctggtcatgccacagctgctggggactccgcctactccagccctcttgggacacactgtgggatttgtggcccttccccagaggaattgtggagactgtcccatggaacaaaccctcaggcaccagcacagggctctgggtgactcagtaaaactaacgtttgtctctgacaagatcagctgtaggctcaccggccagagaagaccactgtgagcattttgccgtatatcctgccctgccatttgttcactttttaaactaaaataggaacatccgacacacaccgtttgcatcgtcttctcccttgatattttaagcattttcccatgtcatgagtttctcagaaacatgtttttaacaattgtactatttagtcattgtccatttactataatttatctgaccatttccctactgtaaaatacttaagacggtttctgatttttccactatttaaataatgctgtgatgaatatctttaaaatcttctgatttcttacttttttcccccttagatgcctggaagtgg

SEQ ID NO: 280399 - DNA, 1785 bp, Homo sapiens
ctgggctcgggtgatcctcctgtcttagccttccaaggtgctgggattacaggtgtgggccaccatgcccagccaccatcttggtttaatttctttccttggaaatggagcaaagggctttcactcttctttttcatggctgcatagtattccataattgtttaaacaattgataatagacactgtatcggggtgactggtatacccccaaaatcacatctgcccagagcctcaggacatggccttgtttggaaatggttttagcagatgcagctaagatgaggtcaccccgtgttaggatggccccgaatccagtgcctggcacccttataaggagagggaaacttggacgcagacaggaaggccgggtgaagacagaagcagagaccgggggccaaggagtgcctggggttgcccagagccaccacgggctgcaagaggtgtgggacagactctctcagccacagaagggcccagccccgcacaggcctggatttcagagggcgaacatttctgtggccgaagctcccagtgcgtttgcagtccttggagacggccgcagacacatttgttcttggcctgtctccaggtctgtagcccccacagtgagcggccactggccggaggggaacaggaagagctggaggggacgtcacacacatgagccttttaggaataacgagtgacacgtgcaagaccccaaaccaaacaccatgtaacctgacacccagggagggagggagggaggggctgggaggggctcacctgtagggaggggctcacctgtacagcggtgctgggaagctggcctcgagggtccccgaggggatacagggccgtgcagcctcttgcctgagggtttgcatgtctgcctggatcccccgggctcctgccagaaggcctctgaggccaccgttgacagcataaaggccacccagtgtctcggcaaccacgctgaccactccctcctcccagctgcggggtgaggtggcctcgagggaagggctggagagtcgttctgagtatttaacaactgggggtgacacagtgtgggtgggcaaggccagggccactgccaggtggggtccgtggccctgagcccccagctctatgcaccccccacctggggtctggcttctccatctccacacccccttgaggggcttctgtctccccctgccccttcgatcgcaggaggcagtgcctggccggggtcgcaggcacctgtcaccccagctcctcactcctcacccactcacatccagtccgtttgtaaaatacacccaggatgagacctgcacgcagtggctcacagcagcacgatttgtgacagcccgaggcggagaacaccgaacacccagtgaaggtgaggggatcagcacggcgcggccacccacgcacccacgcgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtattttaccacaataaacaaaacaaaacaaaaccaaaccaaa

SEQ ID NO: 280400 - DNA, 331 bp, Homo sapiens
gcggccccctactactactaaattcgcggccgcgtcgacctctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggca

SEQ ID NO: 280401 - DNA, 837 bp, Homo sapiens
gaccacctcgcctgtgtctccacagaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgatgagacctgcacgcagtggctcacagcagcacgatttgtgacagcccgaggcggagaacaccgaacacccagtgaaggtgaggggatcagcacggcgcggccacccacgcacccacgcgctggaacgagactcagccacaaggaggtgcgaagctctgacccaggccacagtgcggatgcaccttgaggatgtcacgctcagtgagagacaccagacacagaagggtacgctgtgatcccacttctgtcttctgggtcaaagggaccatgtctgcagagggatcctgtggctggaagcgaggaggctccatcacgggcgtcggcagctacccgaaggcagggatctgggcaatccaggcacggccatgacccctccgaggctcttcttgggttgtggactgctgcttgcaggaacccaaggcgtgaacgatggtgaccatgcggttggccgaatgggggccgcccactatccagtgaccgcgttgcagaatcttctacagcaggccagtgtggcactgtggtgtgacagcctgtggaacctactgatgcccacgttgtctgcggggcctgggtcggaacgcaac

SEQ ID NO: 280402 - DNA, 349 bp, Homo sapiens
ttacacactcacaagcttaaaacacaaattttacttgtttttatttaaaaagtccggatccagcagtgagaaggaagccagtgtagcgcgtggctgtcctccgaggaggggcaccctcggctgtgaggttcttctgggtgtatcgcgcagcgagtgctttttccgggttcagggggctggggagattgaaagctaaagggatgctgcagaaatttaattttaggggggctggagcccccaaggtgcaggatgggaccaggccccaaagggtggacccccagcctctcgtccacggggtggggtgtggcagggccgcgcccacagcttctcctctgcatcgtgggcccgc

SEQ ID NO: 280403 - DNA, 2175 bp, Homo sapiens
ccaccgatcgccccccccccccccccccttctgctagtcgaggcctggtttaatcggccgagggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcggggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggca

SEQ ID NO: 280404 - DNA, 3275 bp, Homo sapiens
ggctgcagagtcgagcgtggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcggggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggcagcctggctcctgtctgcctgcgggggggctctgggcaggggtagcctgggcatctcagccctgccctggttgtgggcggccagcgagcccagtgtctgcctctgtcccgagcctctggtcccctgggactaggttagtgccccctcatctgggtgcagagacagtgggtgcatcctggtagcatgcctttatcggggagtgggtgtgagggaaggcggggaccgctggcaggtggaggggcagtatggttccaggacccactcccggtagttctgggtggtgccgggcgggcgctggggtgccgacagggagggcacgtagtctgatgccctccacagtggctccaccccgtaccggttcctgttgagcactgtaggtgggactcgggtcaccatgtgcccccacctcctcgccgttggccagcaaggggctcctggatcgccccgggcagtttcaccctggcctaggtggccttgtccccctggcctcccaaggacccaccctgcacctagcctcaccgtattccttgccccggattggcctgtctttccacagcgcgctcccccaccgggtgctgggggcctggtactgggcagggacgatggggtcatgccaggcggtctcccgcaggtgctgggtgtaggctgcggtggggcgggggctggcggtcattcctgtccccctctggcaggcccgctgcccagggcgggggggggggcactcacccgatggcatgctgcactcacggtgttggtagcagctgtgccagcggttgtaggcctcgcggaaggggctggccggggcccgtggcaggttgtaccaggcttcccaggcgtccgagttggtcaggcctgtgtaccacagctgggccggctgcgtcccgtcccatgggcgtgtacttccagcgtgtggcctgcctgatggctggtggccagcgggaaccctccagggacaggtagtcatcgctgagggtgggcagggggcagagactgagcccatgtctacagcgagtgctttgacccctttgcgatgtctgccagggtggatgatgtagaggcctggcccacggcgtggggtctccctccctcgccacttggagtctgtccttcagccctgtacccctcaccccagag

SEQ ID NO: 280405 - DNA, 2106 bp, Homo sapiens
ggctgcagagtcgagcgtggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcggggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgatgagacctgcacgcagtggctcacagcagcacgatttgtgacagcccgaggcggagaacaccgaacacccagtgaaggtgaggggatcagcacggcgcggccacccacgcacccacgcgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtattttaccacaataaacaaaacaaaacaaaaccaaaccaaa

SEQ ID NO: 280406 - DNA, 2271 bp, Homo sapiens
ggctgcagagtcgagcgtggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcggggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggcaaaaaaacatagacaaaacagggcgcggaaaaaatatccagaggccagatatcgaatacacgttttgaaagggcctaagggccaaataacaaccgccggtaacctcgaggacaacaacggtctgaagctt

SEQ ID NO: 280407 - DNA, 2308 bp, Homo sapiens
ggctgcagagtcgagcgtggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcggggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctcttttcttgcctggagaagagggaggggagaggacaagggccctggctactcctggattcctacagtccttgtccagcctccaagacccacaagtcccttcctctgggaagcccccctggcctggaggtgcaccaggaagaagtggtctggggctggcactaagccatggcccagggaagactgggggacccactaggccaggatgagacctgcacgcagtggctcacagcagcacgatttgtgacagcccgaggcggagaacaccgaacacccagtgaaggtgaggggatcagcacggcgcggccacccacgcacccacgcgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtattttaccacaataaacaaaacaaaacaaaaccaaaccaaa

SEQ ID NO: 280408 - DNA, 2095 bp, Homo sapiens
ccaccgatcgccccccccccccccccccttctgctagtcgaggcctggtttaatcggccgagggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggca

SEQ ID NO: 280409 - DNA, 2116 bp, Homo sapiens
ggctgcagagtcgagcgtggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcggggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacgggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggca

SEQ ID NO: 280410 - DNA, 2257 bp, Homo sapiens
tttgagtacagggttggcgttgacttcggttgtgggcgtggcctctgcttggtgggcgtggttttctgctggagaacgggcccacaggaccaaggggagggtgccgcccccaaggagtggaagtgggcgggaccttagagtgggcagagctggcattgtgcggtgggcggggcctggacttagagtggcagaggacctgtcaggggcgtggcagctggcacggggcggggtctcagcttccagaggaaaatgggctgtgggcggagccacaagcaattcaaatccagcctggggcggggcttcgaggctggggcgggagcccggggcctcccccagctcagcgcagggactctcacctcctcctcgtgggaccccttctcgcccgcgcgtggaccctcgccgcgctcttgcttgacagtcaccacgaagcccccatgctggcccggagccttgccgcccgccggcctggagccaaggataccgcggtcagccccgtcccaagaatctcccctcccccaaaagcccaccccagggcgttttgacccccgacggcggggctgcagcgagagtgcatgagcccgaggaggcagggtctgatggggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggca

SEQ ID NO: 280411 - DNA, 2216 bp, Homo sapiens
cttcttctcctggatcttctccgtgcacatcttataggcttcagactgctggtacgcccgcagctccttcatgtactgctgcttctctctctcggcctcatccaggtaccgctgcttttccgttggctgcagcttgctccactcggcgcccagcatcttggtgatctcgggaaagggcagatccgggtggcgcgtgcggatctgctcgcgccgctcgttcaggaagcgcacgtagcccgtgaccggtgccttgggcccattcggcagaatcttcttccgcttcttgcccttgggccagccgcgtttcttcaccggctcctcctcgtgggaccccttctcgcccgcgcgtggaccctcgccgcgctcttgcttgacagtcaccacgaagcccccatgctggcccggagccttgccgcccgccggcctggagccaaggataccgcggtcagccccgtcccaagaatctcccctcccccaaaagcccaccccagggcgttttgacccccgacggcggggctgcagcgagagtgcatgagcccgaggaggcagggtctgatggggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggca

SEQ ID NO: 280412 - DNA, 3139 bp, Homo sapiens
ggctgcagagtcgagcgtggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcggggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctcttttcttgcctggagaagagggaggggagaggacaagggccctggctactcctggattcctacagtccttgtccagcctccaagacccacaagtcccttcctctgggaagcccccctggcctggaggtgcaccaggaagaagtggtctggggctggcactaagccatggcccagggaagactgggggacccactaggccaggtgtgtggctcacgcttgtaaacccagcactttgggaggctgaggcaggtggatcacttgaggtcaggagttcgagaccagcctggccagcatggtaaaaccccatctctactaaaaatacgaaaattaagccaggcatggtgtgggggcggggggcacctgtaatcccagctactcaggaggctgaggcaggagaatcgcttgaacccaggaagtggagtttgcagtaagctgagatcgtgcccttgcactccagcctgggcaacagagtgagactctgtctcaaaaacaaaaagacaagagactcaaagatgttttatgctttgaccttgctcttgggaatatgtcccaaggaagtcatcccagaaaacaaggttgctggcccaagacagtctagcagggttcaaaacaatctcatctgccctgcacggaaagcccggttccagctctcatggcaggaactctgcttaaatcctgactagactcccaggtgcccacagaacatgggagtagcctggtcagttacagagcctgtttgagggaccccacatagactcggcttttccactagaaaggcaatttcaagatcaggagaacctcacccttttgaaatgaattgcaagacacatgtagcttttaaaacacaattaaaacagcacaaaattgtctgggcgcagtggctcatgcctgtaatcccagcactttgggaggccaaggtgggtagatcacctgaggtcgggagttcgagaccagcctgaccaacatggtgaggccccgtctctactaaaaatacaaaaattagtcaggtgtggtgatggacacctgtggtcccagctactcgggaagctgaggcaggagaattagcttgaacccgggaggcggaggttgcagtgagccgagattgcgtcactgcactccagcctgggtgagagagcgagactctgtctcaacacaaacaaaacagcacagaataatattcaatgagaaatgagcccctcacccctgctgtcggccccgtacccacctgccactcactactttctggtgtttcctcccaggagcaggtggtacatgcactcacccccgttattacacagttgcagtgagccaagattgcaccattgcgttccagtcttgcgacaagagtgagactccgtccaaaaaaaaaaacaaaaattagctgggcatgtggcacaaacctgtagtcctagctactcagaaggcttgagatggaagaatcctagaacctgggaggcagaagttgcagtgagccaagattgcgccactgcaccctagcctgggcaacagtatgagactgtctcaaaaaaa

SEQ ID NO: 280413 - DNA, 833 bp, Homo sapiens
ggttcagaacccacacgcgtacatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggca

SEQ ID NO: 280414 - DNA, 1508 bp, Homo sapiens
tggctaggagcaggccgggtgtgtaggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggcagcctggctcctgtctgcctgcgggggggctctgggcaggggtagcctgggcatctcagccctgccctggttgtgggcggccagcgagcccagtgtctgcctctgtcccgagcctctggtcccctgggactaggttagtgccccctcatctgggtgcagagacagtgggtgcatcctggtagcatgcctttatcggggagtgggtgtgagggaaggcggggaccgctggcaggtggaggggcagtatggttccaggacccactcccggtagttctgggtggtgccgggcgggcgctggggtgccgacagggagggcacgtagtctgatgccctccacagtggctccaccccgtaccggttcctgttgagcactgtaggtgggactcgggtcaccatgtgcccccacctcctcgccgttggccagcaaggggctcctggatcgccccgggcagtttcaccctggcctaggtggccttgtccccctggcctcccaaggacccaccctgcacctagcctcaccgtattccttgccccggattggcctgtctttccacagcgcgctcccccaccgggtgctgggggcctggtactgggcagggacgatggggtcatgccaggcggtctcccgcaggtgctgggtgtaggctgcggtggggcgggggctggcggtcattcctgtccccctctggcaggcccgctgcccagggcgggggggggggcactcacccgatggcatgctgcactcacggtgttggtagcagctgtgccagcggttgtaggcctcgcggaaggggctggccggggcccgtggcaggttgtaccaggcttcccaggcgtccgagttggtcaggcctgtgtaccacagctgggccggctgcgtcccgtcccatgggcgtgtacttccagcgtgtggcctgcctgatggctggtggccagcgggaaccctccagggacaggtagtcatcgctgagggtgggcagggggcagagactgagcccatgtctacagcgagtgctttgacccctttgcgatgtctgccagggtggatgatgtagaggcctggcccacggcgtggggtctccctccctcgccacttggagtctgtccttcagccctgtacccctcaccccagag

SEQ ID NO: 280415 - DNA, 1619 bp, Homo sapiens
gggtgcttgaggagagaggctgactccccctctccccacacatcgcaccccaagcacccaagtcagcactaaacctttctgttctcagcttttcttgcctggagaagagggaggggagaggacaagggccctggctactcctggattcctacagtccttgtccagcctccaagacccacaagtcccttcctctgggaagcccccctggcctggaggtgcaccaggaagaagtggtctggggctggcactaagccatggcccagggaagactgggggacccactaggccaggtgtgtggctcacgcttgtaaacccagcactttgggaggctgaggcaggtggatcacttgaggtcaggagttcgagaccagcctggccagcatggtaaaaccccatctctactaaaaatacgaaaattaagccaggcatggtgtgggggcggggggcacctgtaatcccagctactcaggaggctgaggcaggagaatcgcttgaacccaggaagtggagtttgcagtaagctgagatcgtgcccttgcactccagcctgggcaacagagtgagactctgtctcaaaaacaaaaagacaagagactcaaagatgttttatgctttgaccttgctcttgggaatatgtcccaaggaagtcatcccagaaaacaaggttgctggcccaagacagtctagcagggttcaaaacaatctcatctgccctgcacggaaagcccggttccagctctcatggcaggaactctgcttaaatcctgactagactcccaggtgcccacagaacatgggagtagcctggtcagttacagagcctgtttgagggaccccacatagactcggcttttccactagaaaggcaatttcaagatcaggagaacctcacccttttgaaatgaattgcaagacacatgtagcttttaaaacacaattaaaacagcacaaaattgtctgggcgcagtggctcatgcctgtaatcccagcactttgggaggccaaggtgggtagatcacctgaggtcgggagttcgagaccagcctgaccaacatggtgaggccccgtctctactaaaaatacaaaaattagtcaggtgtggtgatggacacctgtggtcccagctactcgggaagctgaggcaggagaattagcttgaacccgggaggcggaggttgcagtgagccgagattgcgtcactgcactccagcctgggtgagagagcgagactctgtctcaacacaaacaaaacagcacagaataatattcaatgagaaatgagcccctcacccctgctgtcggccccgtacccacctgccactcactactttctggtgtttcctcccaggagcaggtggtacatgcactcacccccgttattacacagttgcagtgagccaagattgcaccattgcgttccagtcttgcgacaagagtgagactccgtccaaaaaaaaaaacaaaaattagctgggcatgtggcacaaacctgtagtcctagctactcagaaggcttgagatggaagaatcctagaacctgggaggcagaagttgcagtgagccaagattgcgccactgcaccctagcctgggcaacagtatgagactgtctcaaaaaaa

SEQ ID NO: 280416 - DNA, 1542 bp, Homo sapiens
tgttctggtttttgagacggatcttcgctctgtcgcccaggctggagtgcagtggtgcgattcctggattcctacagtccttgtccagcctccaagacccacaagtcccttcctctgggaagcccccctggcctggaggtgcaccaggaagaagtggtctggggctggcactaagccatggcccagggaagactgggggacccactaggccaggtgtgtggctcacgcttgtaaacccagcactttgggaggctgaggcaggtggatcacttgaggtcaggagttcgagaccagcctggccagcatggtaaaaccccatctctactaaaaatacgaaaattaagccaggcatggtgtgggggcggggggcacctgtaatcccagctactcaggaggctgaggcaggagaatcgcttgaacccaggaagtggagtttgcagtaagctgagatcgtgcccttgcactccagcctgggcaacagagtgagactctgtctcaaaaacaaaaagacaagagactcaaagatgttttatgctttgaccttgctcttgggaatatgtcccaaggaagtcatcccagaaaacaaggttgctggcccaagacagtctagcagggttcaaaacaatctcatctgccctgcacggaaagcccggttccagctctcatggcaggaactctgcttaaatcctgactagactcccaggtgcccacagaacatgggagtagcctggtcagttacagagcctgtttgagggaccccacatagactcggcttttccactagaaaggcaatttcaagatcaggagaacctcacccttttgaaatgaattgcaagacacatgtagcttttaaaacacaattaaaacagcacaaaattgtctgggcgcagtggctcatgcctgtaatcccagcactttgggaggccaaggtgggtagatcacctgaggtcgggagttcgagaccagcctgaccaacatggtgaggccccgtctctactaaaaatacaaaaattagtcaggtgtggtgatggacacctgtggtcccagctactcgggaagctgaggcaggagaattagcttgaacccgggaggcggaggttgcagtgagccgagattgcgtcactgcactccagcctgggtgagagagcgagactctgtctcaacacaaacaaaacagcacagaataatattcaatgagaaatgagcccctcacccctgctgtcggccccgtacccacctgccactcactactttctggtgtttcctcccaggagcaggtggtacatgcactcacccccgttattacacagttgcagtgagccaagattgcaccattgcgttccagtcttgcgacaagagtgagactccgtccaaaaaaaaaaacaaaaattagctgggcatgtggcacaaacctgtagtcctagctactcagaaggcttgagatggaagaatcctagaacctgggaggcagaagttgcagtgagccaagattgcgccactgcaccctagcctgggcaacagtatgagactgtctcaaaaaaa

SEQ ID NO: 280417 - DNA, 300 bp, Homo sapiens
ttttgtcaccaggggccataagcctgggggaccccgactgcagaccctcgctcctgcgtgactgtgtgcatgcggggggcgtctccatctgtgcctcagtttccctctctcctccctccatgtcctcaccctgggagccctggctggtgcgggacagccccgcgactgaccactctgccttccacaggcaccgtctgcgtcctgctgtccttccccttcatcttcagcccctgcctgggctgtggggcggccacgcccgagtgggctgccctcctctactacggcccgttcatcgtgatc

SEQ ID NO: 280418 - DNA, 668 bp, Homo sapiens
gggagtagcctggtcagttacagagcctgtttgagggaccccacatagactcggcttttccactagaaaggcaatttcaagatcaggagaacctcacccttttgaaatgaattgcaagacacatgtagcttttaaaacacaattaaaacagcacaaaattgtctgggcgcagtggctcatgcctgtaatcccagcactttgggaggccaaggtgggtagatcacctgaggtcgggagttcgagaccagcctgaccaacatggtgaggccccgtctctactaaaaatacaaaaattagtcaggtgtggtgatggacacctgtggtcccagctactcgggaagctgaggcaggagaattagcttgaacccgggaggcggaggttgcagtgagccgagattgcgtcactgcactccagcctgggtgagagagcgagactctgtctcaacacaaacaaaacagcacagaataatattcaatgagaaatgagcccctcacccctgctgtcggccccgtacccacctgccactcactactttctggtgtttcctcccaggagcaggtggtacatgcactcacccccgttattacacacttgcgggagcccattcactgcatctccatttttttaaaaaatagaaatagggtcttgcactgggtgcggtggctca

SEQ ID NO: 280419 - DNA, 1641 bp, Homo sapiens
ctgggctcgggtgatcctcctgtcttagccttccaaggtgctgggattacaggtgtgggccaccatgcccagccaccatcttggtttaatttctttccttggaaatggagcaaagggctttcactcttctttttcatggctgcatagtattccataattgtttaaacaattgataatagacactgtatcggggtgactggtatacccccaaaatcacatctgcccagagcctcaggacatggccttgtttggaaatggttttagcagatgcagctaagatgaggtcaccccgtgttaggatggccccgaatccagtgcctggcacccttataaggagagggaaacttggacgcagacaggaaggccgggtgaagacagaagcagagaccgggggccaaggagtgcctggggttgcccagagccaccacgggctgcaagaggtgtgggacagactctctcagccacagaagggcccagccccgcacaggcctggatttcagagggcgaacatttctgtggccgaagctcccagtgcgtttgcagtccttggagacggccgcagacacatttgttcttggcctgtctccaggtctgtagcccccacagtgagcggccactggccggaggggaacaggaagagctggaggggacgtcacacacatgagccttttaggaataacgagtgacacgtgcaagaccccaaaccaaacaccatgtaacctgacacccagggagggagggagggaggggctgggaggggctcacctgtagggaggggctcacctgtacagcggtgctgggaagctggcctcgagggtccccgaggggatacagggccgtgcagcctcttgcctgagggtttgcatgtctgcctggatcccccgggctcctgccagaaggcctctgaggccaccgttgacagcataaaggccacccagtgtctcggcaaccacgctgaccactccctcctcccagctgcggggtgaggtggcctcgagggaagggctggagagtcgttctgagtatttaacaactgggggtgacacagtgtgggtgggcaaggccagggccactgccaggtggggtccgtggccctgagcccccagctctatgcaccccccacctggggtctggcttctccatctccacacccccttgaggggcttctgtctccccctgccccttcgatcgcaggaggcagtgcctggccggggtcgcaggcacctgtcaccccagctcctcactcctcacccactcacatccagtccgtttgtaaaatacacccaggatgagacctgcacgcagtggctcacagcagcacgatttgtgacagcccgaggcggagaacaccgaacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtattttaccacaataaacaaaacaaaacaaaaccaaaccaaa

SEQ ID NO: 280420 - DNA, 2142 bp, Homo sapiens
ggctgcagagtcgagcgtggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcggggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggca

SEQ ID NO: 280421 - DNA, 3046 bp, Homo sapiens
ggctgcagagtcgagcgtggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcggggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggcagcctggctcctgtctgcctgcgggggggctctgggcaggggtagcctgggcatctcagccctgccctggttgtgggcggccagcgagcccagtgtctgcctctgtcccgagcctctggtcccctgggactaggttagtgccccctcatctgggtgcagagacagtgggtgcatcctggtagcatgcctttatcggggagtgggtgtgagggaaggcggggaccgctggcaggtggaggggcagtatggttccaggacccactcccggtagttctgggtggtgccgggcgggcgctggggtgccgacagggagggcacgtagtctgatgccctccacagtggctccaccccgtaccggttcctgttgagcacgtattccttgccccggattggcctgtctttccacagcgcgctcccccaccgggtgctgggggcctggtactgggcagggacgatggggtcatgccaggcggtctcccgcaggtgctgggtgtaggccgatggcatgctgcactcacggtgttggtagcagctgtgccagcggttgtaggcctcgcggaaggggctggccggggcccgtggcaggttgtaccaggcttcccaggcgtccgagttggtcaggcctgtgtaccacagctgggccggctgcgtcccgtcccatgggcgtgtacttccagcgtgtggcctgcctgatggctggtggccagcgggaaccctccagggacaggtagtcatcgctgagggtgggcagggggcagagactgagcccatgtctacagcgagtgctttgacccctttgcgatgtctgccagggtggatgatgtagaggcctggcccacggcgtggggtctccctccctcgccacttggagtctgtccttcagccctgtacccctcaccccagag

SEQ ID NO: 280422 - DNA, 2354 bp, Homo sapiens
ggctgcagagtcgagcgtggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcggggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggcaaaacaaacacgacaacgcacaacagacaccgaaacgaacccgcccgaaacacagagagaacaacacacaaaagaaacgccaagaacacaccactcacgaagacacgaaccaaaagagggagggggcccccacaaaaaaacccacgcccaggggagagcgcaccaaagacgccacccccacgtccccgaggaaggcggggcccaccacaagag

SEQ ID NO: 280423 - DNA, 2218 bp, Homo sapiens
ggctgcagagtcgagcgtggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcggggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgtgagtcctggcccacccctccctccccagacactgacccacactctctaatgccatttccacccctcccttgcaggggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggca

SEQ ID NO: 280424 - DNA, 2294 bp, Homo sapiens
ggctgcagagtcgagcgtggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcggggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgatgagacctgcacgcagtggctcacagcagcacgatttgtgacagcccgaggcggagaacaccgaacacccagtgaaggtgaggggatcagcacggcgcggccacccacgcacccacgcgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtattttaccacaataaacaaaacaaaacaaaaccaaaccaaaaaaaacaacaagcaagatctcggagcggtctatttccgggttgcgacaacacgcggttctcggcacggcccgtcggtcataggcggctcccggccccacgccttttcgttacagcggggacgactccgccggccccctaatctgactcgcattatttacaacaggccggttacctgctatgacctcgc

SEQ ID NO: 280425 - DNA, 2545 bp, Homo sapiens
ttacacactcacaagcttaaaacacaaattttacttgtttttatttaaaaagtccggatccagcagtgagaaggagccacccccaccagggtccctcggctggaggagagcaggatgggcaaagccggcccccacccatctggggtacaggcatgcgggggacaccccaggtaagtccccacaaggcagcttcctgtgtggcctatggcacagccccccgtagtgagtaatttggggggtcctgccgtgtgctgggggtgggtttcgtctgccctgtgtcctgggggtggcccggagagccagtgtagcgcgtggctgtcctccgaggaggggcaccctcggctgtgaggttcttctgggtgtatcgcgcagcgagtgctttttccgggttcagggggctggggagattgaaagctaaagggatgctgcagaaatttaattttaggggggctggagcccccaaggtgcaggatgggaccaggccccaaagggtggacccccagcctctcgtccacggggtggggtgtggcagggccgcgccgctcgttcaggaagcgcacgtagcccgtgaccggtgccttgggcccattcggcagaatcttcttccgcttcttgcccttgggccagccgcgtttcttcaccggctcctcctcgtgggaccccttctcgcccgcgcgtggaccctcgccgcgctcttgcttgacagtcaccacgaagcccccatgctggcccggagccttgccgcccgccggcctggagccaaggataccgcggtcagccccgtcccaagaatctcccctcccccaaaagcccaccccagggcgttttgacccccgacggcggggctgcagcgagagtgcatgagcccgaggaggcagggtctgatggggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggca

SEQ ID NO: 280426 - DNA, 1971 bp, Homo sapiens
ggctgcagagtcgagcgtggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcggggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggca

SEQ ID NO: 280427 - DNA, 2400 bp, Homo sapiens
ttacacactcacaagcttaaaacacaaattttacttgtttttatttaaaaagtccggatccagcagtgagaaggagccacccccaccagggtccctcggctggaggagagcaggatgggcaaagccggcccccacccatctggggtacaggcatgcgggggacaccccaggtaagtccccacaaggcagcttcctgtgtggcctatggcacagccccccgtagtgagtaatttggggggtcctgccgtgtgctgggggtgggtttcgtctgccctgtgtcctgggggtggcccggagagccagtgtagcgcgtggctgtcctccgaggaggggcaccctcggctgtgaggttcttctgggtgtatcgcgcagcgagtgctttttccgggttcagggggctggggagattgaaagctaaagggatgctgcagaaatttaattttaggggggctggagcccccaaggtgcaggatgggaccaggccccaaagggtggacccccagcctctcgtccacggggtggggtgtggcagggccgcgccgctcgttcaggaagcgcacgtagcccgtgaccggtgccttgggcccattcggcagaatcttcttccgcttcttgcccttgggccagccgcgtttcttcaccggctcctcctcgtgggaccccttctcgcccgcgcgtggaccctcgccgcgctcttgcttgacagtcaccacgaagcccccatgctggcccggagccttgccgcccgccggcctggagccaaggataccgcggtcagccccgtcccaagaatctcccctcccccaaaagcccaccccagggcgttttgacccccgacggcggggctgcagcgagagtgcatgagcccgaggaggcagggtctgatggggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcagaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggca

SEQ ID NO: 280428 - DNA, 2116 bp, Homo sapiens
ttacacactcacaagcttaaaacacaaattttacttgtttttatttaaaaagtccggatccagcagtgagaaggagccacccccaccagggtccctcggctggaggagagcaggatgggcaaagccggcccccacccatctggggtacaggcatgcgggggacaccccaggtaagtccccacaaggcagcttcctgtgtggcctatggcacagccccccgtagtgagtaatttggggggtcctgccgtgtgctgggggtgggtttcgtctgccctgtgtcctgggggtggcccggagagccagtgtagcgcgtggctgtcctccgaggaggggcaccctcggctgtgaggttcttctgggtgtatcgcgcagcgagtgctttttccgggttcagggggctggggagattgaaagctaaagggatgctgcagaaatttaattttaggggggctggagcccccaaggtgcaggatgggaccaggccccaaagggtggacccccagcctctcgtccacggggtggggtgtggcagggccgcgccgctcgttcaggaagcgcacgtagcccgtgaccggtgccttgggcccattcggcagaatcttcttccgcttcttgcccttgggccagccgcgtttcttcaccggctcctcctcgtgggaccccttctcgcccgcgcgtggaccctcgccgcgctcttgcttgacagtcaccacgaagcccccatgctggcccggagccttgccgcccgccggcctggagccaaggataccgcggtcagccccgtcccaagaatctcccctcccccaaaagcccaccccagggcgttttgacccccgacggcggggctgcagcgagagtgcatgagcccgaggaggcagggtctgatggggctggagtgtagtcatcggatctcagctcactgcaacctcgaactcctgggctcaagtgattctcctgcttcagcctctcgagcagttgggaccacagaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggca

SEQ ID NO: 280429 - DNA, 1464 bp, Homo sapiens
gcggccccctactactactaaattcgcggccgcgtcgacctctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggcagcctggctcctgtctgcctgcgggggggctctgggcaggggtagcctgggcatctcagccctgccctggttgtgggcggccagcgagcccagtgtctgcctctgtcccgagcctctggtcccctgggactaggttagtgccccctcatctgggtgcagagacagtgggtgcatcctggtagcatgcctttatcggggagtgggtgtgagggaaggcggggaccgctggcaggtggaggggcagtatggttccaggacccactcccggtagttctgggtggtgccgggcgggcgctggggtgccgacagggagggcacgtagtctgatgccctccacagtggctccaccccgtaccggttcctgttgagcactgtaggtgggactcgggtcaccatgtgcccccacctcctcgccgttggccagcaaggggctcctggatcgccccgggcagtttcaccctggcctaggtggccttgtccccctggcctcccaaggacccaccctgcacctagcctcaccgtattccttgccccggattggcctgtctttccacagcgcgctcccccaccgggtgctgggggcctggtactgggcagggacgatggggtcatgccaggcggtctcccgcaggtgctgggtgtaggctgcggtggggcgggggctggcggtcattcctgtccccctctggcaggcccgctgcccagggcgggggggggggcactcacccgatggcatgctgcactcacggtgttggtagcagctgtgccagcggttgtaggcctcgcggaaggggctggccggggcccgtggcaggttgtaccaggcttcccaggcgtccgagttggtcaggcctgtgtaccacagctgggccggctgcgtcccgtcccatgggcgtgtacttccagcgtgtggcctgcctgatggctggtggccagcgggaaccctccagggacaggtagtcatcgctgagggtgggcagggggcagagactgagcccatgtctacagcgagtgctttgacccctttgcgatgtctgccagggtggatgatgtagaggcctggcccacggcgtggggtctccctccctcgccacttggagtctgtccttcagccctgtacccctcaccccagag

SEQ ID NO: 280430 - DNA, 454 bp, Homo sapiens
tgggttgtagcctggactccgcttggccgagtcactgtaccctggtcctgggcacgaagggtggagctgcaggtcacagctttcccgcgttaggtaatgtgcgggctggggaaactgaggccagcacgggcttcctggaggccacccagtgtggcagtggttggaatcacctgtcagtcaggggttccccaggcctctctgacggcgtagccacgtggggaggaagtgacccaggttcctggcgtcttgttgagtccctgcccgcctgcccgccaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccgggtgagctggagtccgggtgggtcgcctgaagtc

SEQ ID NO: 280431 - DNA, 960 bp, Homo sapiens
tgactctagagagatcccgatccacgtgcattgtgatggtggatggggtgttccagggtgttgtggagcgaaatatgagagacaaactatttttgacggggaaactggggtccaaactggatatcttggtggagaacatggggaggctcagctttgggtctaacagcagtgacttcaagggcctgttgaagccaccaattctggggcaaacaatccttacccagtggatgatgttccctctgaaaattgataaccttgtgaagtggtggtttcccctccagttgccaaaatggccatatcctcaagctccttctggccccacattctactccaaaacatttccaattttaggctcagttggggacacatttctatatctacctggatggaccaagggccaagtctggatcaatgggtttaacttgggccggtactggacaaagcaggggccacaacagaccctctacgtgccaagattcctgctgtttcctaggggagccctcaacaaaattacattgctggaactagaagatgtacctctccagccccaagtccaatttttggataagcctatcctcaatagcactagtactttgcacaggacacatatcaattccctttcagctgatacactgagtgcctctgaaccaatggagttaagtgggcactgaaaggtaggccgggcatggtggctcatgcctgtaatcccagcactttgggaggctgagacgggtggattacctgaggtcaggacttcaagaccagcctggccaacatggtgaaaccccgtctccactaaaaatacaaaaattagccgggcgtgatggtgggcacctctaatcccagctacttgggaggctgagggcaggagaattgcttgaatccaggaggcagaggttgcagtgagtggaggttgtaccactgcactccagcctggctgacagtgagacactccatctc

SEQ ID NO: 280432 - DNA, 2407 bp, Homo sapiens
agtgctgacatcatcagtccgcgccggcgtaacggcccgcggtatctcagcaaccgctgggcatccggaggatgtggggacgcggagctgagaggctccgggctagctaggtgtaggggtggacgggtcccaggaccctggtgagggttctctacttggccttcggtgggggtcaagacgcaggcacctacgccaaaggggagcaaagccgggctcggcccgaggcccccaggacctccatctcccaatgttggaggttccctcccaggaatccgacacgtgacggtctgtccgccgtctcagactagaggagcgctgtaaacgccatggctcccaagaagctgtcctgccttcgttccctgctgctgccgctcagcctgacgctactgctgccccaggcagacactcggtcgttcgtagtggataggggtcatgaccggtttctcctagacggggccccgttccgctatgtgtctggcagcctgcactactttcgggtaccgcgggtgctttgggccgaccggcttttgaagatgcgatggagcggcctcaacgccatacagttttatgtgccctggaactaccacgagccacagcctggggtctataactttaatggcagccgggacctcattgcctttctgaatgaggcagctctagcgaacctgttggtcatactgagaccaggaccttacatctgtgcagagtgggagatgggggggtctcccatcctggttgcttcgaaaacctgaaattcatctaaagaacctcagatccagacttccttgccgcagtggactcctggttcaaggtcttgctgcccaagatatatccatggctttatcacaatgggggcaacatcattagcattcagctgacaacatgaccaaaatctttaccctgcttcggaagtatgaaccccatgggccattggtaaactctgagtactacacaggctggctggattactggggccagaatcactccacacggtctgtgtcagctgtaaccaaaggactagagaacatgctcaagttgggagccagtgtgaacatgtacatgttccatggaggtaccaactttggatattggaatggtgccgataagaagggacgcttccttccgattactaccagctatgactatgatgcacctatatctgaagcaggggaccccacacctaagctttttgctcttcgagatgtcatcagcaagttccaggaagttcctttgggacctttacctcccccgagccccaagatgatgcttggacctgtgactctgcacctggttgggcatttactggctttcctagacttgctttgcccccgtgggcccattcattcaatcttgccaatgacctttgaggctgtcaagcaggaccatggcttcatgttgtaccgaacctatatgacccataccatttttgagccaacaccattctgggtgccaaataatggagtccatgaccgtgcctatgtgatggtggatggggtgttccagggtgttgtggagcgaaatatgagagacaaactatttttgacggggaaactggggtccaaactggatatcttggtggagaacatggggaggctcagctttgggtctaacagcagtgacttcaagggcctgttgaagccaccaattctggggcaaacaatccttacccagtggatgatgttccctctgaaaattgataaccttgtgaagtggtggtttcccctccagttgccaaaatggccatatcctcaagctccttctggccccacattctactccaaaacatttccaattttaggctcagttggggacacatttctatatctacctggatggaccaagggccaagtctggatcaatgggtttaacttgggccggtactggacaaagcaggggccacaacagaccctctacgtgccaagattcctgctgtttcctaggggagccctcaacaaaattacattgctggaactagaagatgtacctctccagccccaagtccaatttttggataagcctatcctcaatagcactagtactttgcacaggacacatatcaattccctttcagctgatacactgagtgcctctgaaccaatggagttaagtgggcactgaaaggtaggccgggcatggtggctcatgcctgtaatcccagcactttgggaggctgagacgggtggattacctgaggtcaggacttcaagaccagcctggccaacatggtgaaaccccgtctccactaaaaatacaaaaattagccgggcgtgatggtgggcacctctaatcccagctacttgggaggctgagggcaggagaattgcttgaatccaggaggcagaggttgcagtgagtggaggttgtaccactgcactccagcctggctgacagtgagacactccatctc

SEQ ID NO: 280433 - DNA, 1636 bp, Homo sapiens
ccacaagattgtgtatgaggtgcggcctcgggttgtcaattcgatgcgaggggatccgggtctttatctacaatgtgggcaactagtcactacgacattcagactgacaacatgaccaaaatctttaccctgcttcggaagtatgaaccccatgggccattggtaaactctgagtactacacaggctggctggattactggggccagaatcactccacacggtctgtgtcagctgtaaccaaaggactagagaacatgctcaagttgggagccagtgtgaacatgtacatgttccatggaggtaccaactttggatattggaatggtgccgataagaagggacgcttccttccgattactaccagctatgactatgatgcacctatatctgaagcaggggaccccacacctaagctttttgctcttcgagatgtcatcagcaagttccaggaagttcctttgggacctttacctcccccgagccccaagatgatgcttggacctgtgactctgcacctggttgggcatttactggctttcctagacttgctttgcccccgtgggcccattcattcaatcttgccaatgacctttgaggctgtcaagcaggaccatggcttcatgttgtaccgaacctatatgacccataccatttttgagccaacaccattctgggtgccaaataatggagtccatgaccgtgcctatgtgatggtggatggggtgttccagggtgttgtggagcgaaatatgagagacaaactatttttgacggggaaactggggtccaaactggatatcttggtggagaacatggggaggctcagctttgggtctaacagcagtgacttcaagggcctgttgaagccaccaattctggggcaaacaatccttacccagtggatgatgttccctctgaaaattgataaccttgtgaagtggtggtttcccctccagttgccaaaatggccatatcctcaagctccttctggccccacattctactccaaaacatttccaattttaggctcagttggggacacatttctatatctacctggatggaccaagggccaagtctggatcaatgggtttaacttgggccggtactggacaaagcaggggccacaacagaccctctacgtgccaagattcctgctgtttcctaggggagccctcaacaaaattacattgctggaactagaagatgtacctctccagccccaagtccaatttttggataagcctatcctcaatagcactagtactttgcacaggacacatatcaattccctttcagctgatacactgagtgcctctgaaccaatggagttaagtgggcactgaaaggtaggccgggcatggtggctcatgcctgtaatcccagcactttgggaggctgagacgggtggattacctgaggtcaggacttcaagaccagcctggccaacatggtgaaaccccgtctccactaaaaatacaaaaattagccgggcgtgatggtgggcacctctaatcccagctacttgggaggctgagggcaggagaattgcttgaatccaggaggcagaggttgcagtgagtggaggttgtaccactgcactccagcctggctgacagtgagacactccatctc

SEQ ID NO: 280434 - DNA, 265 bp, Homo sapiens
tttcctatgttcaaatttcattggcgtgcaaatatacaaggtgcttagggttgggaatttcttgacaagagtcattgcttcccatatttagtggtgagcaagtgtgatggtagcacctaacacagaagctctgctccttcctttagacttccttgccgcagtggactcctggttcaaggtcttgctgcccaagatatatccatggctttatcacaatgggggcaacatcattagcattcagtacaagggggaagtgactggagca

SEQ ID NO: 280435 - DNA, 1955 bp, Homo sapiens
gtgatataggcgagtcctagaagcgaagttcgagtagtcacacagttagcggtcgcccgtgccgtgcagaccggctttgaagatgcgatggagcgagctcaacgccataaagtttatgtgccctggaactaccacgagccacagcctggggtctataactttaatggcagccgggacctcattgcctttctgaatgaggcagctctagcgaacctgttggtcatactgagaccaggaccttacatctgtgcagagtgggagatgggggggtctcccatcctggttgcttcgaaaacctgaaattcatctaaagaacctcagatccagacttccttgccgcagtggactcctggttcaaggtcttgctgcccaagatatatccatggctttatcacaatgggggcaacatcattagcattcagctgacaacatgaccaaaatctttaccctgcttcggaagtatgaaccccatgggccattggtaaactctgagtactacacaggctggctggattactggggccagaatcactccacacggtctgtgtcagctgtaaccaaaggactagagaacatgctcaagttgggagccagtgtgaacatgtacatgttccatggaggtaccaactttggatattggaatggtgccgataagaagggacgcttccttccgattactaccagctatgactatgatgcacctatatctgaagcaggggaccccacacctaagctttttgctcttcgagatgtcatcagcaagttccaggaagttcctttgggacctttacctcccccgagccccaagatgatgcttggacctgtgactctgcacctggttgggcatttactggctttcctagacttgctttgcccccgtgggcccattcattcaatcttgccaatgacctttgaggctgtcaagcaggaccatggcttcatgttgtaccgaacctatatgacccataccatttttgagccaacaccattctgggtgccaaataatggagtccatgaccgtgcctatgtgatggtggatggggtgttccagggtgttgtggagcgaaatatgagagacaaactatttttgacggggaaactggggtccaaactggatatcttggtggagaacatggggaggctcagctttgggtctaacagcagtgacttcaagggcctgttgaagccaccaattctggggcaaacaatccttacccagtggatgatgttccctctgaaaattgataaccttgtgaagtggtggtttcccctccagttgccaaaatggccatatcctcaagctccttctggccccacattctactccaaaacatttccaattttaggctcagttggggacacatttctatatctacctggatggaccaagggccaagtctggatcaatgggtttaacttgggccggtactggacaaagcaggggccacaacagaccctctacgtgccaagattcctgctgtttcctaggggagccctcaacaaaattacattgctggaactagaagatgtacctctccagccccaagtccaatttttggataagcctatcctcaatagcactagtactttgcacaggacacatatcaattccctttcagctgatacactgagtgcctctgaaccaatggagttaagtgggcactgaaaggtaggccgggcatggtggctcatgcctgtaatcccagcactttgggaggctgagacgggtggattacctgaggtcaggacttcaagaccagcctggccaacatggtgaaaccccgtctccactaaaaatacaaaaattagccgggcgtgatggtgggcacctctaatcccagctacttgggaggctgagggcaggagaattgcttgaatccaggaggcagaggttgcagtgagtggaggttgtaccactgcactccagcctggctgacagtgagacactccatctc

SEQ ID NO: 280436 - DNA, 1704 bp, Homo sapiens
agaatgaatatggtagctacagagcctgtgacttcagctacatgaggcacttggctgggctcttccgtgcactgctaggagaaaagatcttgctcttcaccacagatgggcctgaaggactcaagtgtggctccctccggggactctataccactgtagattttggcccagctgacaacatgaccaaaatctttaccctgcttcggaagtatgaaccccatgggccattggtaaactctgagtactacacaggctggctggattactggggccagaatcactccacacggtctgtgtcagctgtaaccaaaggactagagaacatgctcaagttgggagccagtgtgaacatgtacatgttccatggaggtaccaactttggatattggaatggtgccgataagaagggacgcttccttccgattactaccagctatgactatgatgcacctatatctgaagcaggggaccccacacctaagctttttgctcttcgagatgtcatcagcaagttccaggaagttcctttgggacctttacctcccccgagccccaagatgatgcttggacctgtgactctgcacctggttgggcatttactggctttcctagacttgctttgcccccgtgggcccattcattcaatcttgccaatgacctttgaggctgtcaagcaggaccatggcttcatgttgtaccgaacctatatgacccataccatttttgagccaacaccattctgggtgccaaataatggagtccatgaccgtgcctatgtgatggtggatggggtgttccagggtgttgtggagcgaaatatgagagacaaactatttttgacggggaaactggggtccaaactggatatcttggtggagaacatggggaggctcagctttgggtctaacagcagtgacttcaagggcctgttgaagccaccaattctggggcaaacaatccttacccagtggatgatgttccctctgaaaattgataaccttgtgaagtggtggtttcccctccagttgccaaaatggccatatcctcaagctccttctggccccacattctactccaaaacatttccaattttaggctcagttggggacacatttctatatctacctggatggaccaagggccaagtctggatcaatgggtttaacttgggccggtactggacaaagcaggggccacaacagaccctctacgtgccaagattcctgctgtttcctaggggagccctcaacaaaattacattgctggaactagaagatgtacctctccagccccaagtccaatttttggataagcctatcctcaatagcactagtactttgcacaggacacatatcaattccctttcagctgatacactgagtgcctctgaaccaatggagttaagtgggcactgaaaggtaggccgggcatggtggctcatgcctgtaatcccagcactttgggaggctgagacgggtggattacctgaggtcaggacttcaagaccagcctggccaacatggtgaaaccccgtctccactaaaaatacaaaaattagccgggcgtgatggtgggcacctctaatcccagctacttgggaggctgagggcaggagaattgcttgaatccaggaggcagaggttgcagtgagtggaggttgtaccactgcactccagcctggctgacagtgagacactccatctc

SEQ ID NO: 280437 - DNA, 420 bp, Homo sapiens
caggacaaaatagattcatcttcaacattccctgcatattatcagagctgatataaacgggaagagggaagtactggtttggtgatacattgctgccatatcccaggagaagaccttcaagctttacatttggacttggacgcaagaacttcaagaggatggagtcacttgtggtattgatgtggactttgaggtttggccttttacctaacaatgggaatgaaaacatcgatggctgttacttcccctttttagcatcctacccaacttcccagcaagtgttggtggctagaggcattgttcttgaaaaacatgttgtctactttgctactcagtattacagcacacacccaaacgcccaaaatgaagctaaataacatagagcagcctagaataaaaagtatatcttactgttcaata

SEQ ID NO: 280438 - DNA, 483 bp, Homo sapiens
gtgcctcagcctcgcgaatagctgggattacagtgcaaaggggaagagtcagaaggtgaataaatactcacagccgaagctcttcaaaagacttcaccgagtacagaggggagtttggatcccgctgcaggacttccacttggtttgtgttatcaacaaggttgcttctgatcagcttgttgagtaaggactgggcagctctgtcctctgtcaggaaaaagaaagcaaagaattttaaaaagtccttgaaacctaccaggcgtttactctaattcaactgccatttgtattttaaataataatgtactgaacattcaaattcaaggtacgtcatagttttgacttataaattaaaatagttttattaaagaaaaaagttatgatacatcacccatttaggcctcatattcttttccagactctattctaacagccctcttttcctgcagttatctattcctcctatccagacccacatattta

SEQ ID NO: 280439 - DNA, 3275 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgt

SEQ ID NO: 280440 - DNA, 1704 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcagaagaaaagccacgccacttaagtttggcagagatgacgggcagccctttgcatagagcttttccctggacttggagttggtctttccctgaggatctaggactttgggcccttctgtgctacctccaaggaatcagtcacctctgttctgctgagtctggagaccaggtggtggggtggacggggcataaggaagagtgatgcatacacagtgctagagtacagaatgcagtaagtgatccatgggggcagagagcaaggtaccgcatgatcagaagagagaactagtgctaccgccttgcttgtctagtacattaaaacttacaagtcatgttcacacttctctgctca

SEQ ID NO: 280441 - DNA, 864 bp, Homo sapiens
ctcaagaaagtctccaccagggttaatccattgcaggcacgcttcaccctcagcctcatctctccttgctaggggtggtgccaaggcctagaaaattccaagtctgagggtcacttaaccattcttcaaagattggcttaggcccagcctcacaacaccccacctcccagatggattcatctccctgaaatcctcaccttcttgaagttgacactggaccgttcacctgattagcgctcccaaatggatcatcaacccttagtcgtagtgctaacagtgtttatcctctgagtgaatactcagattcgtactttgtgtggtgctgtcaaaccatgacctcattgaccttcacaaccactccttatgaggcagatttaactgtccccattttcaaggtaagaaattgaggtaggtgatgtgcctgacccaggatcacacacccagtgagtgattgaactgtgatataaactaccacaccacacctttcctggagcagcgagagatgactccagcctctcctcctcaccaacgactgaaataggatatttctgtctaatgtagaggatagggcacaaggcttctctgtctccccagtgtcttactcctcctccatggcacactgacccagagggtttgcagccccaccccaacccaaaccctaaccctgtaataaaactggcccagggagcctctgaggctctcataaaagtttccctgtctcctaattggcaagggaaaggacaggcccactctccgcccaggcctgccttgcatctcattttggttgcttctgctaggtgggaaggagtgagtgagtcactccagaaaagccctcacctgtgtatgtccttgtcttctctctca

SEQ ID NO: 280442 - DNA, 544 bp, Homo sapiens
tcatagctgtcagagttaccgaaatctcgaagttgtgcatcaactacgccaatgagaagctgcagcagcattttgtggctcactacctaagggcccagcaggtgagggatggggtgagcaggaggcaggtccttcttttggatcctcaatcccttcctgaccttccagccccagtccaggttctgattagaagcctttggttccttcttattttatttttaattgacaaataataattgcacaacttgtcgagattcgaatctcgacaagttgtgcagccgagcgtggcccaactgagatcaacaatggtagacccagcgatcaactggtttttcctaaaaatgaacggtgaactggaacagactaaagacaaacgggaacaagcccaaaatgaactgagtgcctggaagtttacgcctgatagccaaacagggaaaaagttaatggcgaagtgtcgaatgcttatccaggagaatcaagagcttggaaggcagctgtcccaggaacgtatggcacaactggtcgagattcgggtaccgagctc

SEQ ID NO: 280443 - DNA, 516 bp, Homo sapiens
cgtggtggctcacacctgtaatcctagcacttcgggaggccgaggtgggaggatcacctgaggtcaggagttcgagaccagcctggtcaacatggtgaaagcccgtctctactaaaaatacaaaaattagccaggctggtggcacatgcctgtagtcccagttactccagaggctgaggcaagaggattgcttgagcctgggagattgaagctacagccttacggaggctacaataagctgttcgtgccacttgccaactccaagccttggggggccaaaggaacgccccgttgattccattcccaagtatgaactaagaagcagcagtaagagacaaacacaaaaacagaacaaaaagagagaaaacacacaaaaaaaaaaataaaaaaggggggcggcgccgctcatcaaggattatcctcccagaggggggcccaagatttgtgcggatgagcgccagtttctgtggtgcgacagagggtgcccccatataggggagccgtgttatttaaaca

SEQ ID NO: 280444 - DNA, 4672 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcagagatggagtctcactctgtagacaaggctggtctcaaactcctgacctcaagtgatccgtctgcctcagcctcccaaggtgcttttacaggggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280445 - DNA, 6164 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtgtgagggtcagggtgtaggatggggcaggccctgtcaggaaggtagccagcattgctggggttgggtggaaggctggatggtgaaaattggaatctgatgcccttgcttatgccacccaccatagggcctggccctggatcatttactcctcaccctgtctggtgaggcagacagtatcgtccccatcttaaagatgagaaaatgagtcagaggtttgtaaagtgatttgtcccatacatggcagcatggactggtacatgaaagtgctgggtttgagttctgactgctgtttatggagtcctttgggtgagtcacttcactgatcagaacttaggtttcttctgtccagttgggcaagtcatggtcccgctgtgatgacttcacagtgcctcgtgaagaggactggatggagagtgatttgcctaaagaggatttgcccctcccagactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggtagcaaggcctcactgtgctgggagcactccagaaaaagagcaataaagccctggatggagaggcaggagccctgggtccactgtgtgactctgggcagttcctttcccttttttgtctcctcttgcatctgcctgccagcatagagcgagatctctgcatagggtgagatctctgctctcctgcacccacatctgagcagtccataactctccagacaggctcaacagtgccttgtctgaaagagccctttacctccccagagacccagctctaattgtgggagagtagtgggggttggggaaaatagctgtattagaagggactttggaggctggcaccgtggctcacacctgtaatcccaacattttgggaggccaaagtgggaggatcactggaggccaggagttggagaccagcctgggcaatatagcaagaccccatttcaaagaaattagccaggcatggtgctacatgcctgtagtcccagctactcaggagaccgaggtgggaggatcactttagcccaagagtttgaagcttctgtgagctgtgatcacaccactgcactccagcctggtcaacagagcaagaccctatctcaggggggagaacaaaaaaagacttgggggacatgactgagggaggtcaacacggttgtaactaggtgggacagtcagttataggaggaaataaagcttaaaggtacaagtgcagtttgctcatggaatggtggaattctaggcaccaaattggctagtgagactaatgccctccgaactagatttaacacagaaaatgttccctgggacctggtttcctcataggaggtgcctatcagaaccagagaattcagactcaaaaatgggcctgatgctctgggctgtcttcacacttcatttgggtttcctgcttgctctgagctctacaggggaatggggtagagatgggagccaccttgggtggagggtggggaaggtatgttctgcccaccacaggtgtcatgctcactcagcctgatgcccaggctgccaagtataaggcattggcaggggcccagccaccctgggttccttggtcccctattccccatctgctccctgcagtggccccatgggttctctgccatcttcccaggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280446 - DNA, 4663 bp, Homo sapiens
ctcaagaaagtctccaccagggttaatccattgcaggcacgcttcaccctcagcctcatctctccttgctaggggtggtgccaaggcctagaaaattccaagtctgagggtcacttaaccattcttcaaagattggcttaggcccagcctcacaacaccccacctcccagatggattcatctccctgaaatcctcaccttcttgaagttgacactggaccgttcacctgattagcgctcccaaatggatcatcaacccttagtcgtagtgctaacagtgtttatcctctgagtgaatactcagattcgtactttgtgtggtgctgtcaaaccatgacctcattgaccttcacaaccactccttatgaggcagatttaactgtccccattttcaaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280447 - DNA, 4844 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacagattggcttaggcccagcctcacaacaccccacctcccagatggattcatctccctgaaatcctcaccttcttgaagttgacactggaccgttcacctgattagcgctcccaaatggatcatcaacccttagtcgtagtgctaacagtgtttatcctctgagtgaatactcagattcgtactttgtgtggtgctgtcaaaccatgacctcattgaccttcacaaccactccttatgaggcagatttaactgtccccattttcaaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280448 - DNA, 3992 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280449 - DNA, 3769 bp, Homo sapiens
ctcataacgtctctccagttcaatggaaaccaagtcactccacaaacaaaggtgctctgtaagaagtggaggctaagcgttgtctaagcgttgtctttaattcctttctcagaccctgacagctgtttaggccaactttttttccctttatgacaactcaaaccattacctgctgggctctagggctggaatgaatttaaggagaaggtaaaaaccaaaaggagttcatcagatgaaaagatgtattaaccaacatgttcatagtggtcttattttgaaaaggaaaagtgttggaaagaacccaaatatctaacagtggtgacatcatggccaaatgatggactggaccatccctatgatgcagctaagtgtttttgaagaatattataaatttaatggagaaccacttccaaaatgatattcatacctagatgtcaaactacatattaagggcgatgccctccttttaaggtgtgtttgtgtgtgtgtaggcattaaaaaattgtataaggaagctgggcacagtagttcgctcctgtaatcccagcattttgggaggctgaggtgggaggatcacttgagcccaggaatttcataccagccgggcaacatggcaaaaccctttctctactaaaaatacaaaaattagccaagtgtggtagtatgcacctataatcctagctactcaggaggctgaggcaggagaatcacctcaacccaggaggcagaggttgcagtgagctgagattgcaccattacactccagcctgggtgacagagcaagactctgtctcaaaaaaaaaaaaaacaacaaaacataattaaccgtgcctggtggcacatgcctgtagtcccagttactccagaggctgaggcaagaggattgcttgagcctgggagattgaagctacagccttacggaggctacaataagctgttcgtgccactgcactccagcctgggcaagaccctgtctcaaaaaaaaaaaaaaaaaaaaaaaaaaaaacaaaaagaaaaagaatatgctgaaattgcagagaagggaataaaaattaccaccatctattaattgtatcagtgtttgggtatatggtgatgtgagatcagggatgcataaagcgaacaaattcaactgaggattaaaaacaaaacaaaaaaaaaagtttttaaaggcacagacaatccagacccctcccattccctgggtgctgacctggacccagcctgagacgggaagtgattgctgggccctcagccagtccttctccccagtgccccttcactgtgttgtgtaggtgtattcaagtgtgtgggcagtgtaaggaatgtttaaaagccaattttgccttatgtattgattttagaaccttatttgtagcaatttattgaaaaaaaaaaaacgtatttgaaactttgacagcaactgtggtgctgctgcagcgaggtcactgacagctctaatggcccctttattatctctttcctgtttctgggcaaacctcttagccattcgttcctggttaactcggaaacacatccagaggctgcatgcagctgccacagtcatcaagcgtgcatggcagaagtggagagtaagtaagacccaagaagtcggggtgggcagtggatcaattttggggaccagatggacccgagtgggaatgctggctctgccactgcaatgcaggtggccttgggcaggttgtttagcctctctgagcctcatattcctcatgtatgcagtgggcacagtaacacctaccctgcagggtggttatgtaggtgaagagtggtataagcaactctgggaatataccaaactctgggatgtacactttagaagactgggttttatggcatatcagttatatcttgatggactcttatcttgttttcaagtagcatatgtaaggcctaagcacagttgcctggggtgtatagacttgtggcatatggaaccagtttggttcagggcagccagctgtttgcaaccaggtgccttcagttcaccttgttaagatgatttgttaaagatagttttgatttccattttctgctaagagggctagataaatctaaagctataaagggatatttgctttttaagatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280450 - DNA, 4527 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcaggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280451 - DNA, 3254 bp, Homo sapiens
ctcataacgtctctccagttcaatggaaaccaagtcactccacaaacaaaggtgctctgtaagaagtggaggctaagcgttgtctaagcgttgtctttaattcctttctcagaccctgacagctgtttaggccaactttttttccctttatgacaactcaaaccattacctgctgggctctagggctggaatgaatttaaggagaaggtaaaaaccaaaaggagttcatcagatgaaaagatgtattaaccaacatgttcatagtggtcttattttgaaaaggaaaagtgttggaaagaacccaaatatctaacagtggtgacatcatggccaaatgatggactggaccatccctatgatgcagctaagtgtttttgaagaatattataaatttaatggagaaccacttccaaaatgatattcatacctagatgtcaaactacatattaagggcgatgccctccttttaaggtgtgtttgtgtgtgtgtaggcattaaaaaattgtataaggaagctgggcacagtagttcgctcctgtaatcccagcattttgggaggctgaggtgggaggatcacttgagcccaggaatttcataccagccgggcaacatggcaaaaccctttctctactaaaaatacaaaaattagccaagtgtggtagtatgcacctataatcctagctactcaggaggctgaggcaggagaatcacctcaacccaggaggcagaggttgcagtgagctgagattgcaccattacactccagcctgggtgacagagcaagactctgtctcaaaaaaaaaaaaaacaacaaaacataattaaccgtgcctggtggcacatgcctgtagtcccagttactccagaggctgaggcaagaggattgcttgagcctgggagattgaagctacagccttacggaggctacaataagctgttcgtgccactgcactccagcctgggcaagaccctgtctcaaaaaaaaaaaaaaaaaaaaaaaaaaaaacaaaaagaaaaagaatatgctgaaattgcagagaagggaataaaaattaccaccatctattaattgtatcagtgtttgggtatatggtgatgtgagatcagggatgcataaagcgaacaaattcaactgaggattaaaaacaaaacaaaaaaaaaagtttttaaaggcacagacaatccagacccctcccattccctgggtgctgacctggacccagcctgagacgggaagtgattgctgggccctcagccagtccttctccccagtgccccttcactgtgttgtgtaggtgtattcaagtgtgtgggcagtgtaaggaatgtttaaaagccaattttgccttatgtattgattttagaaccttatttgtagcaatttattgaaaaaaaaaaaacgtatttgaaactttgacagcaactgtggtgctgctgcagcgaggtcactgacagctctaatggcccctttattatctctttcctgtttctgggcaaacctcttagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280452 - DNA, 2581 bp, Homo sapiens
gattttttaaatttattttttaatttattctttttatttgcagtagaagattcccaaactaagggctgggattggatctcccttttcccatacatggtggggagttgaggggtcggggctgagggagtggcctatagctgccctatttggccctcaggatgtgtgtttgggccttggaaacaaatgctggctgagcagcctgggattccaagcttggaaggagtcacccttccaggtgtcaagcaccctctgccagcctgcccaaagggactcatggcagtagaggctgtgggacaccccaggacacacaggcgcaagtgggtattccaaggctccacggaacagctagcaccctgagggacaacagagaggctgtttgtggcttcctccaaaagaagaacaaggagaaaatggctagagccaagaacagcaggaaagagacctgtagagtgctagggaggccaaagccagtttcttcaggccacagaggcatgtagagatgaccatgcactgatggggccatctccctcccccagaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280453 - DNA, 3810 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcaggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgt

SEQ ID NO: 280454 - DNA, 3955 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcaggtacgttgtgtgtgatggccatgacagctttgttcctgagaacagcaggagcaaagcctacaagttcacagcgggaatgagactgaggctgggacaagatccatccctaaccctactgggtaaaccagagggctgcatgtccccatcaggctgcaggtttggattatttattttgttataactgggaatcttccagagccctttatctttttaaaaactgcttctaattatttcagcatctctaaatcttctagtcccatttccaaatgcaatgctgcgtttctagcaagctcccagctgattctgatgctccatgaaccacactgtgagaaccaaggctttagatgagtcaggagcaggaggtgatgaaagtttagcttagggcctggagcggtggctcacgcctataatcccagtactttgggaagtcgaggcgggtgtatcacctgaggtcaggagttcaagaccagcctggccaacatggcgaaaccccatctctactaaaaatacaaaaattggttgggcgtagtggcaggcgcctgtagtcccagctgctcgggaggctgaggcatgagaattgcttgaatctgggagggagaggttgcagtgagccgagattgcgccgctgcactccagcctgggtgacaggacgagagtccattagggcacgcggcaggctggacagcggtatttgggcttctccaagcagatcacgcagacgacggtgctacatttgagcgacg

SEQ ID NO: 280455 - DNA, 3364 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtgggtggcgctgagaagagcacggtgatgaggctgggggaaggaggtccttcaaggacagggacgcgaggatacaccccaccgccgccctatgggaaagcagaccagatctggctcctctctcacaaggggagaggagaagatatggggatcgcccgaacaactcctagagaaaatgt

SEQ ID NO: 280456 - DNA, 1956 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtgtgagggtcagggtgtaggatggggcaggccctgtcaggaaggtagccagcattgctggggttgggtggaaggctggatggtgaaaattggaatctgatgcccttgcttatgccacccaccatagggcctggccctggatcatttactcctcaccctgtctggtgaggcagacagtatcgtccccatcttaaagatgagaaaatgagtcagaggtttgtaaagtgatttgtcccatacatggcagcatggactggtacatgaaagtgctgggtttgagttctgactgctgtttatggagtcctttgggtgagtcacttcactgatcagaacttaggtttcttctgtccagttgggcaagtcatggtcccgctgtgatgacttcacagtgcctcgtgaagaggactggatggagagtgatttgcctaaagaggatttgcccctcccagactctgtcaggacggcagcctcgctgtacggacacgcctcgtgcggggatcctctatcacgcgggacac

SEQ ID NO: 280457 - DNA, 1252 bp, Homo sapiens
  misc_feature (3)..(3): n is a, c, g, or t
  misc_feature (67)..(67): n is a, c, g, or t
  misc_feature (69)..(69): n is a, c, g, or t
  misc_feature (91)..(91): n is a, c, g, or t
  misc_feature (93)..(93): n is a, c, g, or t
  misc_feature (104)..(104): n is a, c, g, or t
  misc_feature (138)..(138): n is a, c, g, or t
ganctttcccctcaccaaacctgtacatttgagagatctcagagtaatgccacatctggtttatgcnanccagattcttagagagcccgcngnttctggtgggngcctgctgacaaactgatgcctcaccaggtaatnctttacacaaagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcagaagaaaagccacgccacttaagtttggcagagatgacgggcagccctttgcatagagcttttccctggacttggagttggtctttccctgaggatctaggactttgggcccttctgtgctacctccaaggaatcagtcacctctgttctgctgagtctggagaccaggtggtggggtggacggggcataaggaagagtgatgcatacacagtgctagagtacagaatgcagtaagtgatccatgggggcagagagcaaggtaccgcatgatcagaagagagaactagtgctaccgccttgcttgtctagtacattaaaacttacaagtcatgttcacacttctctgctca

SEQ ID NO: 280458 - DNA, 1359 bp, Homo sapiens
ctcataacgtctctccagttcaatggaaaccaagtcactccacaaacaaaggtgctctgtaagaagtggaggctaagcgttgtctaagcgttgtctttaattcctttctcagaccctgacagctgtttaggccaactttttttccctttatgacaactcaaaccattacctgctgggctctagggctggaatgaatttaaggagaaggtaaaaaccaaaaggagttcatcagatgaaaagatgtattaaccaacatgttcatagtggtcttattttgaaaaggaaaagtgttggaaagaacccaaatatctaacagtggtgacatcatggccaaatgatggactggaccatccctatgatgcagctaagtgtttttgaagaatattataaatttaatggagaaccacttccaaaatgatattcatacctagatgtcaaactacatattaagggcgatgccctccttttaaggtgtgtttgtgtgtgtgtaggcattaaaaaattgtataaggaagctgggcacagtagttcgctcctgtaatcccagcattttgggaggctgaggtgggaggatcacttgagcccaggaatttcataccagccgggcaacatggcaaaaccctttctctactaaaaatacaaaaattagccaagtgtggtagtatgcacctataatcctagctactcaggaggctgaggcaggagaatcacctcaacccaggaggcagaggttgcagtgagctgagattgcaccattacactccagcctgggtgacagagcaagactctgtctcaaaaaaaaaaaaaacaacaaaacataattaaccgtgcctggtggcacatgcctgtagtcccagttactccagaggctgaggcaagaggattgcttgagcctgggagattgaagctacagccttacggaggctacaataagctgttcgtgccactgcactccagcctgggcaagaccctgtctcaaaaaaaaaaaaaaaaaaaaaaaaaaaaacaaaaagaaaaagaatatgctgaaattgcagagaagggaataaaaattaccaccatctattaattgtatcagtgtttgggtatatggtgatgtgagatcagggatgcataaagcgaacaaattcaactgaggattaaaaacaaaacaaaaaaaaaagtttttaaaggcacagacaatccagacccctcccattccctgggtgctgacctggacccagcctgagacgggaagtgattgctgggccctcagccagtccttctccccagtgccccttcactgtgttgtgtagaacttgaacgttccatttctacaccaccagaaattaaattgatgggcttacaaaataaattgaa

SEQ ID NO: 280459 - DNA, 811 bp, Homo sapiens
ctcaagaaagtctccaccagggttaatccattgcaggcacgcttcaccctcagcctcatctctccttgctaggggtggtgccaaggcctagaaaattccaagtctgagggtcacttaaccattcttcaaagattggcttaggcccagcctcacaacaccccacctcccagatggattcatctccctgaaatcctcaccttcttgaagttgacactggaccgttcacctgattagcgctcccaaatggatcatcaacccttagtcgtagtgctaacagtgtttatcctctgagtgaatactcagattcgtactttgtgtggtgctgtcaaaccatgacctcattgaccttcacaaccactccttatgaggcagatttaactgtccccattttcaaggcgctggagtgacttgtctgagattcctccagaactgagccctttgttggaaccataccccagcccatggtcccatgactaggtggatagtactccttgtacctcctgcaacccagaaccctgcttttccctggacttggagttggtctttccctgaggatctaggactttgggcccttctgtgctacctccaaggaatcagtcacctctgttctgctgagtctggagaccaggtggtggggtggacggggcataaggaagagtgatgcatacacagtgctagagtacagaatgcagtaagtgatccatgggggcagagagcaaggtaccgcatgatcagaagagagaactagtgctaccgccttgcttgtctagtacattaaaacttacaagtcatgttcacacttctctgctca

SEQ ID NO: 280460 - DNA, 317 bp, Homo sapiens
gtgaacatgacttgtaagttttaatgtactagacaagcaaggcggtacactagttctctcttctgatcatgcggtaccttgctctctgcctccaaggaatcagtcacctctgttctgctgagtctggagaccaggtggtggggtggacggggcataaggaagagtgatgcatacacagtgctagagtacagaatgcagtaagtgatccatgggggcagagagcaaggtaccgcatgatcagaagagagaactagtgctaccgccttgcttgtctagtacattaaaacttacaagtcatgttcacacttctctgctca

SEQ ID NO: 280461 - DNA, 263 bp, Homo sapiens
cctccagatgggggctgctcagacactgccaggtaagaacttgacagaaggacagtacctggggacaagcccaggataagtggacaacactgggagtcggggcaggagtgctttgggggtgggcatgaccctctgccacagcccttctgcctggtgggcatggcagtcttctggagcaagttgtggccggaagaccagtagcacatggaggcaccctgcctgggaccatataggaatggtgggtggggtccctgtgtcaggtc

SEQ ID NO: 280462 - DNA, 219 bp, Homo sapiens
gtcttctctctcatgccacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtaaaacctcaaccttagataacccaggccctcaagcacctgc

SEQ ID NO: 280463 - DNA, 514 bp, Homo sapiens
actttgtagaacgatacaagttactaagaaggcttcatccttgcacatcctctggccccgacagcccatatcctgccaaagggctccctggtgagtgggacccatgagttagtcatttgtgcaaccacagtttactgagcatctaccctgtgccctgtcttagggctaggggctggggcttactggtgaataaaacacagccctggttttggttcagtgggggaaacagattcaaaaaagacaaatagcatggaaagtggaaaagcagagctatgagcaggatgctgtgggtggtgctagggaggtgtgaattggggaaggcttcctggaagaggtagtatctgagaataaattggattagccaggtgatgggtggtccacatgataaatgtaatctgaacaaaggcctagaggcttgaggcagcagtgtgggtatgaggaactccagccagttctgtgttgctggttcattgaggcagagaactggggcaggtgaggctggagtggcaggtag

SEQ ID NO: 280464 - DNA, 471 bp, Homo sapiens
tcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattcccctaaaaattaacaagaaaaaaagc

SEQ ID NO: 280465 - DNA, 432 bp, Homo sapiens
agtacttgtccataccttcttgcatttttagcgtctgctctgtggggttgttaggccctggcactcccaggaactagtgctaaagctgcatctctctctcccctctagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtggg

SEQ ID NO: 280466 - DNA, 4225 bp, Homo sapiens
cctcaagctaatttcaggtcacaatttgaggtcaaaggcttttaaagcctttgcctacaagtcactccaagatgagcagataaagtgtgatgaacacagatagagtgagcttctgaccacaggacatttgcacagcccctgttgcaaaaagagccagtttatttactgaagggaaaaaagttgcagagcaattactttaagaaaaaatgtgaggaagaaacccctgtatagtgctgtacgtgtcagcgtcttgtgtggtagtctcatcttctctgggctggggccggttctagagtggaggatgccattgttgacctcgggactgggggcccacttgtgcagaactacatcagggggtatggtggggccttgagctctgggctccaccggtagagttttgcaggggtgttcaatgaactcagttatttacaaaccacacccaggcccatctgccccttcccaagacactagctgggtctcgagccatgtgactgagctcgactgattccctccccagcctaggagctgagcttgtcctgtgctcagtcttcccataaggacatgccaggtttgtgtgtacctggcaacatgcatgcccatagcctgcatctgtagtaggtcaagacgtgataggccggaagcaagaggagaggatttggtctttgacctgtcaggctcagaatacaagggccccccagggtgtagcaccctgatggggggagcaattttaccacccctttgactcagccagaccctcttaccagagtccactctcttcccccaacaggttgtttgactggctggtatcagtgatcaacagcagcatctgtgcagacaccgactcgtggaccactttcataggtagcaaggcctcactgtgctgggagcactccagaaaaagagcaataaagccctggatggagaggcaggagccctgggtccactgtgtgactctgggcagttcctttcccttttttgtctcctcttgcatctgcctgccagcatagagcgagatctctgcatagggtgagatctctgctctcctgcacccacatctgagcagtccataactctccagacaggctcaacagtgccttgtctgaaagagccctttacctccccagagacccagctctaattgtgggagagtagtgggggttggggaaaatagctgtattagaagggactttggaggctggcaccgtggctcacacctgtaatcccaacattttgggaggccaaagtgggaggatcactggaggccaggagttggagaccagcctgggcaatatagcaagaccccatttcaaagaaattagccaggcatggtgctacatgcctgtagtcccagctactcaggagaccgaggtgggaggatcactttagcccaagagtttgaagcttctgtgagctgtgatcacaccactgcactccagcctggtcaacagagcaagaccctatctcaggggggagaacaaaaaaagacttgggggacatgactgagggaggtcaacacggttgtaactaggtgggacagtcagttataggaggaaataaagcttaaaggtacaagtgcagtttgctcatggaatggtggaattctaggcaccaaattggctagtgagactaatgccctccgaactagatttaacacagaaaatgttccctgggacctggtttcctcataggaggtgcctatcagaaccagagaattcagactcaaaaatgggcctgatgctctgggctgtcttcacacttcatttgggtttcctgcttgctctgagctctacaggggaatggggtagagatgggagccaccttgggtggagggtggggaaggtatgttctgcccaccacaggtgtcatgctcactcagcctgatgcccaggctgccaagtataaggcattggcaggggcccagccaccctgggttccttggtcccctattccccatctgctccctgcagtggccccatgggttctctgccatcttcccaggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgcctctgtcttcagagaggcactgggcatctaaggtggtcagagccctcagaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgt

SEQ ID NO: 280467 - DNA, 4580 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280468 - DNA, 5027 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtgtgagggtcagggtgtaggatggggcaggccctgtcaggaaggtagccagcattgctggggttgggtggaaggctggatggtgaaaattggaatctgatgcccttgcttatgccacccaccatagggcctggccctggatcatttactcctcaccctgtctggtgaggcagacagtatcgtccccatcttaaagatgagaaaatgagtcagaggtttgtaaagtgatttgtcccatacatggcagcatggactggtacatgaaagtgctgggtttgagttctgactgctgtttatggagtcctttgggtgagtcacttcactgatcagaacttaggtttcttctgtccagttgggcaagtcatggtcccgctgtgatgacttcacagtgcctcgtgaagaggactggatggagagtgatttgcctaaagaggatttgcccctcccagactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280469 - DNA, 5095 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagagtaagtaagacccaagaagtcggggtgggcagtggatcaattttggggaccagatggacccgagtgggaatgctggctctgccactgcaatgcaggtggccttgggcaggttgtttagcctctctgagcctcatattcctcatgtatgcagtgggcacagtaacacctaccctgcagggtggttatgtaggtgaagagtggtataagcaactctgggaatataccaaactctgggatgtacactttagaagactgggttttatggcatatcagttatatcttgatggactcttatcttgttttcaagtagcatatgtaaggcctaagcacagttgcctggggtgtatagacttgtggcatatggaaccagtttggttcagggcagccagctgtttgcaaccaggtgccttcagttcaccttgttaagatgatttgttaaagatagttttgatttccattttctgctaagagggctagataaatctaaagctataaagggatatttgctttttaagatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280470 - DNA, 4668 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccggtgagtgtcaacccgaacctatatctgaagcccttcagacgcggaaggggcttgggaggccagtttgccccgcagcggtgaggaagaatgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280471 - DNA, 3391 bp, Homo sapiens
cgtgccccgtcgtcctctggaacatgagactgccccagagcagcaggaggggatagataggatggcctggcagtcgagaaagggaggccacttcagggaggtagcaatgcagtggaaagtgaccctcacctccagatgggggctgctcagacactgccaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280472 - DNA, 2443 bp, Homo sapiens
agggggacttgggaccaccaggaccctttctagtgggagatttgttttcaaggtccctcgatttctcacagccccaaggagatacccccattagccaagccttgggagagcctgcagcttggcactggccagggtctaagaagaagggctgagagaatggcatttctggcctgctggccccatgctgcaggtgcctgccctgtctccccacccttgcaggtccgtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280473 - DNA, 1136 bp, Homo sapiens
gcggccgctccaacatcagtgcttgatgtagcctggaaccccaggcccactgacgcactgggcacggggctctgggtcgaaggctggagccgtcactgttgttcatgtgcatttggagcactgtgggaataggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatcatctgaatgtcaagttttctctccataaaggacttgccaccttaaggaccccaagtctgcctgaaacatgagccacatcaatgccggtaaaggcctgcatgacctaatctgcatcctggaaacctcttttgcctgagctccccagccccaaactagctggtctgggagagggagcaggcaggttccaggagtcaagcacacgcttgagcaagcagcacaataatccatcttaagactcctcattctgggatggctccacaattcctaaacagcagtctgcaaactccacaaacaaaggctcttgcatgtaagctctcatgagctttgctttgtcttctccctgatcgaggttgaccatcaactgcctgaggtgtggattgagcaataagcttcttaatgttgcagattccccttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280474 - DNA, 4057 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcaggtacgttgtgtgtgatggccatgacagctttgttcctgagaacagcaggagcaaagcctacaagttcacagcgggaatgagactgaggctgggacaagatccatccctaaccctactgggtaaaccagagggctgcatgtccccatcaggctgcaggtttggattatttattttgttataactgggaatcttccagagccctttatctttttaaaaactgcttctaattatttcagcatctctaaatcttctagtcccatttccaaatgcaatgctgcgtttctagcaagctcccagctgattctgatgctccatgaaccacactgtgagaaccaaggctttagatgagtcaggagcaggaggtgatgaaagtttagcttagggcctggagcggtggctcacgcctataatcccagtactttgggaagtcgaggcgggtgtatcacctgaggtcaggagttcaagaccagcctggccaacatggcgaaaccccatctctactaaaaatacaaaaattggttgggcgtagtggcaggcgcctgtagtcccagctgctcgggaggctgaggcatgagaattgcttgaatctgggagggagaggttgcagtgagccgagattgcgccgctgcactccagcctgggtgacaggacgagagtccatcttaattctttaaattctgcaaagaaactctgtcttcttcctcatcactattgagaaaatcagctatagagtcatcatcatctttgttttccacaggctttacggttttggtaggaagagctgatcttatttttttctcaacaggacgagtttcagggttgcactgttctgaaaaagacacaaa

SEQ ID NO: 280475 - DNA, 2251 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggtgagggatggggtgagcaggaggcaggtccttcttttggatcctcaatcccttcctgaccttccagccccagtccaggttctgattagaagcctttggttccttcttattttatttttaattgacaaataataattgcacaacttgtcgagattcgaatctcgacaagttgtgcagccgagcgtggcccaactgagatcaacaatggtagacccagcgatcaactggtttttcctaaaaatgaacggtgaactggaacagactaaagacaaacgggaacaagcccaaaatgaactgagtgcctggaagtttacgcctgatagccaaacagggaaaaagttaatggcgaagtgtcgaatgcttatccaggagaatcaagagcttggaaggcagctgtcccaggaacgtatggcacaactggtcgagattcgggtaccgagctc

SEQ ID NO: 280476 - DNA, 1195 bp, Homo sapiens
tgcggttcggcgctcccaggttcctttcctcactgcacgctcttgcccctcctcttttctctcctgcccgtgttgcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcaggtttgtgccaaatggggcca

SEQ ID NO: 280477 - DNA, 6537 bp, Homo sapiens
ttcctggttctgcgggttggcgctgagtttggaagtcgcgcgggaccccttttatagcagcgtgggcgacgtgccacacgggtgtcccagcccaggggctggtctgagctggaagaggttgtgcaaataagggccccacctccacggcaggagggtgagccctaggtccagatgctcacactggcgcaggtctgtcctgagccgacacctgcacagtggcgagaccaaggacccagagagaaaggtgagagtgcagccggggaggctgaggatcggcggagctggaagagtgagggtgaaggcaagaagtagagcacagaagcaaagattttaagaggaaagaagacatctgaacccaacaccaccctaaaccacaggctgcagggttggcatgctccgtgcaagaccagaggcactgatgctcctgggagctcttctgactggatccctgggtccatcgggcagtcaggacgcactctcactgccctgggaagtgcagcgctatgacggctggtttaacaacctgaggcaccacgagcgtggtgctgttggctgccggttgcagcgccgcgtaccagccaattacgccgacggtgtgtatcaggctctggaggagccgcagctgcccaacccgcgccggctcagcaacgcagccacgcggggcatagccggcctgccgtcgctccacaaccgcaccgtactgggggtcttctttggctaccatgttctttccgacgtggtgagcgtggaaacgcccggttgccccgccgagttcctcaacatccgcatcccacctggagaccccgtgttcgaccccgaccagcgcggggacgtggtgctgcccttccagaggagccgctgggaccccgagaccggacggagtcccagcaacccccgggacctggccaaccaggtgacgggctggctggacggcagcgccatctatggctcctcgcactcctggagcgacgcgctgcggagcttctcggggggacagctggcgtcggggcccgaccccgctttcccccgagactcgcagaaccccctgctcatgtgggcggcgcccgaccccgccaccgggcagaacgggccccgggggctgtacgccttcggggcagagagagggaaccgggaacccttcctgcaggcgctgggcctgctctggttccgctaccacaacctgtgggcgcagaggctggcccgccagcacccagactgggaggacgaggagctgttccagcacgcacgcaagagggtcatcgccacctaccagaacatcgctgtgtatgagtggctgcccagcttcctgcagaaaacactcccggagtatacaggataccgtcctttcctagaccccagcatctccccggaatttgtggtggcctctgagcagttcttctctaccatggtgccccctggtgtctacatgagaaatgccagctgtcatttccggaaggtcctgaacaagggttttcaaagctcccaagctctcagggtctgcaacaactactggattcgggagaaccccaatctgaacagtacccaggaggtgaatgagctgctgctgggaatggcctcccagatttcggagttggaggacaacatagtggttgaagatctgagggattactggcctggccctggcaaattctcccgtacagactatgtggccagcagcatccaacgtggccgagatatggggctgcccagctatagccaggccctgctggcctttgggctggacatcccaaggaactggagtgatctcaaccctaatgtggacccccaggtgctggaggccacagctgccctgtacaaccaggacctatcccagctagagctgctccttggcgggctcctggagagccatggggaccctggacccctgttcagtgccattgtcctcgaccagtttgtacggctgcgggatggtgaccgctactggtttgagaacaccaggaatgggctgttctccaagaaggagattgaagacatccgaaataccaccctgcgggacgtgctggtcgctgttatcaacattgaccccagtgccctgcagcccaatgtctttgtctggcataaaggtgcaccctgccctcaacctaagcagctcacaactgacggcctgccccagtgtgcacccctgactgtgcttgacttctttgaaggcagcagccctggttttgccatcaccatcattgctctctgctgccttcccttagtgagtctgcttctctctggagtggtggcctatttccggggccgagaacacaagaagctacaaaagaaactcaaagagagcgtgaagaaggaagcagccaaagatggagtgccagcgatggagtggccaggccccaaggagaggagcagtcccatcatcatccagctgctgtcagacaggtgtctgcaggtcctgaacaggcatctcactgtgctccgtgtggtccagctgcagcctctgcagcaggtcaacctcatcctgtccaacaaccgaggatgccgcaccctgctgctcaagatccctaaggagtatgacctggtgctgctgtttagttctgaagaggaacggggcgcctttgtgcagcagctatgggacttctgcgtgcgctgggctctgggcctccatgtggctgagatgagcgagaaggagctatttaggaaggctgtgacaaagcagcagcgggaacgcatcctggagatcttcttcagacacctttttgctcaggtgctggacatcaaccaggccgacgcagggaccctgcccctggactcctcccagaaggtgcgggaggccctgacctgcgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctccccagaggataagtcccgtctaatgtttaccatgtatgacctggatgagaatggcttcctctccaaggacgaattcttcaccatgatgcgatccttcatcgagatctccaacaactgcctgtccaaggcccagctggccgaggtggtggagtctatgttccgggagtcgggattccaggacaaggaggagctgacatgggaggattttcacttcatgctgcgggaccatgacagcgagctccgcttcacgcagctctgtgtcaaaggtggaggtggaggtggaaatggtattagagatatctttaaacaaaacatcagctgtcgagtctcgttcatcactcggacacctggggagcgctcccacccccagggactggggccccctgccccagaagccccagagctgggaggccctggactgaagaagaggtttggcaaaaaggcagcagtgcccactccccggctgtacacagaggcgctgcaagagaagatgcagcgaggcttcctagcccaaaagctgcagcagtacaagcgcttcgtggagaactaccggaggcacatcgtgtgtgtggcaatcttctcggccatctgtgttggcgtgtttgcagatcgtgcttactactatggctttgccttgccaccctcggacattgcacagaccaccctcgtgggcatcatcctgtcacgaggcacggcggccagcgtctccttcatgttctcttatatcttgctcaccatgtgccgcaacctcataaccttcctgcgagagactttcctcaaccgctatgtgccttttgatgccgcagtggacttccaccgctggatcgccatggctgctgttgtcctggccattttgcacagtgctggccacgcagtcaatgtctacatcttctcagtcagcccactcagcctgctggcctgcatattccccaacgtctttgtgaatgatgggtccaagcttccccagaagttctattggtggttcttccagaccgtcccaggtatgacaggtgtgcttctgctcctggtcctggccatcatgtatgtcttcgcctcccaccacttccgccgccgcagcttccggggcttctggctgacccaccacctctacatcctgctctatgccctgctcatcatccatggcagctatgctctgatccagctgcccactttccacatctacttcctggtcccggcaatcatctatggaggtgacaagctggtgagcctgagccggaagaaggtggagatcagcgtggtgaaggcggagctgctgccctcaggagtgacctacctgcaattccagaggccccaaggctttgagtacaagtcaggacagtgggtgcggatcgcctgcctggctctggggaccaccgagtaccaccccttcacactgacctccgcgccccatgaggacacactcagcctgcacatccgggcagtggggccctggaccactcgcctcagggagatctactcatccccaaagggcaatggctgtgctggatacccaaagctgtaccttgatggaccgtttggagagggccatcaggagtggcataaatttgaggtgtcagtgttggtgggagggggcattggggtcaccccctttgcctccatcctcaaagacctggtcttcaagtcatccttgggcagccaaatgctgtgtaagaagatctacttcatctgggtgacacggacccagcgtcagtttgagtggctggctgacatcatccaagaggtggaggagaacgaccaccaggacctggtgtctgtgcacatttatgtcacccagctggctgagaagttcgacctcaggaccaccatgctatacatctgcgagcggcacttccagaaagtgctgaaccggagtctgttcacgggcctgcgctccatcacccactttggccgtccccccttcgagcccttcttcaactccctgcaggaggtccacccacaggtgcgcaagatcggggtgttcagctgcggccctccaggaatgaccaagaatgtagagaaggcctgtcagctcgtcaacaggcaggaccgagcccacttcatgcaccactatgagaacttctgagcctgtcctccctggctgctgcttccagtatcctgccttctcttctgtgcacctaagttgcccagccctgctggcaatctctccatcagaatccaccttaggcctcagctggagggctgcagagcccctcccaatattgggagaatattgacccagacaattatacaaatgagaaaaggcaggagactatgttctacaattgcagtgcatgatgattataagtccacctgtttatcaacggcaccattcctgcagccctccagacttcctgcccttagcaagtgcgcaaccagtcaggatctcccaaagaagataaagaccactcctcaccccagctcaagccatggcaggcgtggcaagcaaagtggggaggagacagtccctgcttgtgacaagtgtggaggtgaaaaggtacaatagtgcttgtctccgatagctccccacatctctaattgacttccacaaaatcgatgcgttgctttggtatttgcttggactgacatttgagggaggaggaggctgggatcctctggctgagaatctcctcagagcccagtgcagaagctgtgatgcttagaacctggacagcccgactgcctcaactctgtctccaggtctattccctccagctccaaaaggagcagccctacttctaccccttcccgtccccaaagtgtcagcaactttgaggagggcaccaggaaacaaagatgcctccccagccctgatattcttgatgtcaccagtgatacccactgccctgacccctgggcaggcccctctctgcatctactggagtggtccctgggctctggggctgaaggattccagcctctctgccagatattcagtactcgatctcaattcccctcttccacaagagttgggtgaccagctgtcctagtttgcccaggactctccctgttttagcactgaaagtctcttgccccaggaaaccccatcagtcccaggcagattgggacagctggtcaccttacgcaagagccaggctgaaacatcccctccatactcagctctttaacttttcttttcctttttcatcgggctctttcctaaaaagctgagctgtaaaatattttacatcgaggtataataaataatcatgtacatgttttaccaccacccaggtcaagacatagaatgtttcaacatttccatcaccccagaaactccccttgtacccccttccacttcgtctcccctagctcctagaagcaaccactgatgtgatttctaccaaatccagttttggtcctactaaatatactcttttgagactggcctcttttactcaccataatgcctttgtaattcatccatgctgttgtgtgtatcagcagtttgttccttttcattgctgagtagtattctattgtagagatgtaccacagtttgtttattcttctgttgatggacgtttgggttgtttctaattttgaatgattataaataaaaattctgtgagtgttcttgtacgt

SEQ ID NO: 280478 - DNA, 2501 bp, Homo sapiens
  misc_feature (18)..(18): n is a, c, g, or t
atcgagctcgctcctgtnaattcgtgtctacatcctgctctatgcctgctcatcatccatggcagctatgctctgatccagctgcccactttccacatctacttcctggtcccggcaatcatctatggaggtgacaagctggtgagcctgagccggaagaaggtggagatcagcgtggtgaaggcggagctgctgccctcaggagtgacctacctgcaattccagaggccccaaggctttgagtacaagtcaggacagtgggtgcggatcgcctgcctggctctggggaccaccgagtaccaccccttcacactgacctccgcgccccatgaggacacactcagcctgcacatccgggcagtggggccctggaccactcgcctcagggagatctactcatccccaaagggcaatggctgtgctggatacccaaagctgtaccttgatggaccgtttggagagggccatcaggagtggcataaatttgaggtgtcagtgttggtgggagggggcattggggtcaccccctttgcctccatcctcaaagacctggtcttcaagtcatccttgggcagccaaatgctgtgtaagaagatctacttcatctgggtgacacggacccagcgtcagtttgagtggctggctgacatcatccaagaggtggaggagaacgaccaccaggacctggtgtctgtgcacatttatgtcacccagctggctgagaagttcgacctcaggaccaccatgctatacatctgcgagcggcacttccagaaagtgctgaaccggagtctgttcacgggcctgcgctccatcacccactttggccgtccccccttcgagcccttcttcaactccctgcaggaggtccacccacaggtgcgcaagatcggggtgttcagctgcggccctccaggaatgaccaagaatgtagagaaggcctgtcagctcgtcaacaggcaggaccgagcccacttcatgcaccactatgagaacttctgagcctgtcctccctggctgctgcttccagtatcctgccttctcttctgtgcacctaagttgcccagccctgctggcaatctctccatcagaatccaccttaggcctcagctggagggctgcagagcccctcccaatattgggagaatattgacccagacaattatacaaatgagaaaaggcaggagactatgttctacaattgcagtgcatgatgattataagtccacctgtttatcaacggcaccattcctgcagccctccagacttcctgcccttagcaagtgcgcaaccagtcaggatctcccaaagaagataaagaccactcctcaccccagctcaagccatggcaggcgtggcaagcaaagtggggaggagacagtccctgcttgtgacaagtgtggaggtgaaaaggtacaatagtgcttgtctccgatagctccccacatctctaattgacttccacaaaatcgatgcgttgctttggtatttgcttggactgacatttgagggaggaggaggctgggatcctctggctgagaatctcctcagagcccagtgcagaagctgtgatgcttagaacctggacagcccgactgcctcaactctgtctccaggtctattccctccagctccaaaaggagcagccctacttctaccccttcccgtccccaaagtgtcagcaactttgaggagggcaccaggaaacaaagatgcctccccagccctgatattcttgatgtcaccagtgatacccactgccctgacccctgggcaggcccctctctgcatctactggagtggtccctgggctctggggctgaaggattccagcctctctgccagatattcagtactcgatctcaattcccctcttccacaagagttgggtgaccagctgtcctagtttgcccaggactctccctgttttagcactgaaagtctcttgccccaggaaaccccatcagtcccaggcagattgggacagctggtcaccttacgcaagagccaggctgaaacatcccctccatactcagctctttaacttttcttttcctttttcatcgggctctttcctaaaaagctgagctgtaaaatattttacatcgaggtataataaataatcatgtacatgttttaccaccacccaggtcaagacatagaatgtttcaacatttccatcaccccagaaactccccttgtacccccttccacttcgtctcccctagctcctagaagcaaccactgatgtgatttctaccaaatccagttttggtcctactaaatatactcttttgagactggcctcttttactcaccataatgcctttgtaattcatccatgctgttgtgtgtatcagcagtttgttccttttcattgctgagtagtattctattgtagagatgtaccacagtttgtttattcttctgttgatggacgtttgggttgtttctaattttgaatgattataaataaaaattctgtgagtgttcttgtacgt

SEQ ID NO: 280479 - DNA, 560 bp, Homo sapiens
ggctctctccctgctgctccaggccagaatcattctacaaaacaaatcatgagatcctattaattcattttgtgccttgccccctgcctggtaccaggagccactccctacctctaccccatgctctgcccagggagttgttctcctggctgcaaagacaaggggagaacagccccatttctttttctcagctcccacccccagggactggggccccctgccccagaagccccagagctgggaggccctggactgaagaagaggtttggcaaaaagtgagtgtctcccaaatccctgggcccaaagagacatggagagaagtcttagggtccctaggccccacccacatatccttgacatataagcgaccatcctgagtctcattccatttgttcctgacctgactgagaggttacagtgttgaatgacttttcatcctcttccagcctctgcaccccattcttcaggcaagggtcctggctcaacaggatgatagtaaggggtctcctggctcctgcctgctttgggcacagccttgaggcctgtgctgggatcaggaa

SEQ ID NO: 280480 - DNA, 5897 bp, Homo sapiens
ttcctggttctgcgggttggcgctgagtttggaagtcgcgcgggaccccttttatagcagcgtgggcgacgtgccacacgggtgtcccagcccaggggctggtctgagctggaagaggttgtgcaaataagggccccacctccacggcaggagggtgagccctaggtccagatgctcacactggcgcaggtctgtcctgagccgacacctgcacagtggcgagaccaaggacccagagagaaaggtgagagtgcagccggggaggctgaggatcggcggagctggaagagtgagggtgaaggcaagaagtagagcacagaagcaaagattttaagaggaaagaagacatctgaacccaacaccaccctaaaccacaggctgcagggttggcatgctccgtgcaagaccagaggcactgatgctcctgggagctcttctgactggatccctgggtccatcgggcagtcaggacgcactctcactgccctgggaagtgcagcgctatgacggctggtttaacaacctgaggcaccacgagcgtggtgctgttggctgccggttgcagcgccgcgtaccagccaattacgccgacggtgtgtatcaggctctggaggagccgcagctgcccaacccgcgccggctcagcaacgcagccacgcggggcatagccggcctgccgtcgctccacaaccgcaccgtactgggggtcttctttggctaccatgttctttccgacgtggtgagcgtggaaacgcccggttgccccgccgagttcctcaacatccgcatcccacctggagaccccgtgttcgaccccgaccagcgcggggacgtggtgctgcccttccagaggagccgctgggaccccgagaccggacggagtcccagcaacccccgggacctggccaaccaggtgacgggctggctggacggcagcgccatctatggctcctcgcactcctggagcgacgcgctgcggagcttctcggggggacagctggcgtcggggcccgaccccgctttcccccgagactcgcagaaccccctgctcatgtgggcggcgcccgaccccgccaccgggcagaacgggccccgggggctgtacgccttcggggcagagagagggaaccgggaacccttcctgcaggcgctgggcctgctctggttccgctaccacaacctgtgggcgcagaggctggcccgccagcacccagactgggaggacgaggagctgttccagcacgcacgcaagagggtcatcgccacctaccagaacatcgctgtgtatgagtggctgcccagcttcctgcagaaaacactcccggagtatacaggataccgtcctttcctagaccccagcatctccccggaatttgtggtggcctctgagcagttcttctctaccatggtgccccctggtgtctacatgagaaatgccagctgtcatttccggaaggtcctgaacaagggttttcaaagctcccaagctctcagggtctgcaacaactactggattcgggagaaccccaatctgaacagtacccaggaggtgaatgagctgctgctgggaatggcctcccagatttcggagttggaggacaacatagtggttgaagatctgagggattactggcctggccctggcaaattctcccgtacagactatgtggccagcagcatccaacgtggccgagatatggggctgcccagctatagccaggccctgctggcctttgggctggacatcccaaggaactggagtgatctcaaccctaatgtggacccccaggtgctggaggccacagctgccctgtacaaccaggacctatcccagctagagctgctccttggcgggctcctggagagccatggggaccctggacccctgttcagtgccattgtcctcgaccagtttgtacggctgcgggatggtgaccgctactggtttgagaacaccaggaatgggctgttctccaagaaggagattgaagacatccgaaataccaccctgcgggacgtgctggtcgctgttatcaacattgaccccagtgccctgcagcccaatgtctttgtctggcataaaggtgcaccctgccctcaacctaagcagctcacaactgacggcctgccccagtgtgcacccctgactgtgcttgacttctttgaaggcagcagccctggttttgccatcaccatcattgctctctgctgccttcccttagtgagtctgcttctctctggagtggtggcctatttccggggccgagaacacaagaagctacaaaagaaactcaaagagagcgtgaagaaggaagcagccaaagatggagtgccagcgatggagtggccaggccccaaggagaggagcagtcccatcatcatccagctgctgtcagacaggtgtctgcaggtcctgaacaggcatctcactgtgctccgtgtggtccagctgcagcctctgcagcaggtcaacctcatcctgtccaacaaccgaggatgccgcaccctgctgctcaagatccctaaggagtatgacctggtgctgctgtttagttctgaagaggaacggggcgcctttgtgcagcagctatgggacttctgcgtgcgctgggctctgggcctccatgtggctgagatgagcgagaaggagctatttaggaaggctgtgacaaagcagcagcgggaacgcatcctggagatcttcttcagacacctttttgctcaggtgctggacatcaaccaggccgacgcagggaccctgcccctggactcctcccagaaggtgcgggaggccctgacctgcgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctccccagaggataagtcccgtctaatgtttaccatgtatgacctggatgagaatggcttcctctccaaggacgaattcttcaccatgatgcgatccttcatcgagatctccaacaactgcctgtccaaggcccagctggccgaggtggtggagtctatgttccgggagtcgggattccaggacaaggaggagctgacatgggaggattttcacttcatgctgcgggaccatgacagcgagctccgcttcacgcagctctgtgtcaaaggtggaggtggaggtggaaatggtattagagatatctttaaacaaaacatcagctgtcgagtctcgttcatcactcggacacctggggagcgctcccacccccagggactggggccccctgccccagaagccccagagctgggaggccctggactgaagaagaggtttggcaaaaaggcagcagtgcccactccccggctgtacacagaggcgctgcaagagaagatgcagcgaggcttcctagcccaaaagctgcagcagtacaagcgcttcgtggagaactaccggaggcacatcgtgtgtgtggcaatcttctcggccatctgtgttggcgtgtttgcagatcgtgcttactactatggctttgccttgccaccctcggacattgcacagaccaccctcgtgggcatcatcctgtcacgaggcacggcggccagcgtctccttcatgttctcttatatcttgctcaccatgtgccgcaacctcataaccttcctgcgagagactttcctcaaccgctatgtgccttttgatgccgcagtggacttccaccgctggatcgccatggctgctgttgtcctggccattttgcacagtgctggccacgcagtcaatgtctacatcttctcagtcagcccactcagcctgctggcctgcatattccccaacgtctttgtgaatgatgggtccaagcttccccagaagttctattggtggttcttccagaccgtcccaggtatgacaggtgtgcttctgctcctggtcctggccatcatgtatgtcttcgcctcccaccacttccgccgccgcagcttccggggcttctggctgacccaccacctctacatcctgctctatgccctgctcatcatccatggcagctatgctctgatccagctgcccactttccacatctacttcctggtcccggcaatcatctatggaggtgacaagctggtgagcctgagccggaagaaggtggagatcagcgtggtgaaggcggagctgctgccctcaggagtgacctacctgcaattccagaggccccaaggctttgagtacaagtcaggacagtgggtgcggatcgcctgcctggctctggggaccaccgagtaccaccccttcacactgacctccgcgccccatgaggacacactcagcctgcacatccgggcagtggggccctggaccactcgcctcagggagatctactcatccccaaagggcaatggctgtgctggatacccaaagctgtaccttgatggaccgtttggagagggccatcaggagtggcataaatttgaggtgtcagtgttggtgggagggggcattggggtcaccccctttgcctccatcctcaaagacctggtcttcaagtcatccttgggcagccaaatgctgtgtaagaagatctacttcatctgggtgacacggacccagcgtcagtttgagtggctggctgacatcatccaagaggtggaggagaacgaccaccaggacctggtgtctgtgcacatttatgtcacccagctggctgagaagttcgacctcaggaccaccatgctatacatctgcgagcggcacttccagaaagtgctgaaccggagtctgttcacgggcctgcgctccatcacccactttggccgtccccccttcgagcccttcttcaactccctgcaggaggtccacccacaggtgcgcaagatcggggtgttcagctgcggccctccaggaatgaccaagaatgtagagaaggcctgtcagctcgtcaacaggcaggaccgagcccacttcatgcaccactatgagaacttctgagcctgtcctccctggctgctgcttccagtatcctgccttctcttctgtgcacctaagttgcccagccctgctggcaatctctccatcagaatccaccttaggcctcagctggagggctgcagagcccctcccaatattgggagaatattgacccagacaattatacaaatgagaaaaggcaggagactatgttctacaattgcagtgcatgatgattataagtccacctgtttatcaacggcaccattcctgcagccctccagacttcctgcccttagcaagtgcgcaaccagtcaggatctcccaaagaagataaagaccactcctcaccccagctcaagccatggcaggcgtggcaagcaaagtggggaggagacagtccctccatactcagctctttaacttttcttttcctttttcatcgggctctttcctaaaaagctgagctgtaaaatattttacatcgaggtataataaataatcatgtacatgttttaccaccacccaggtcaagacatagaatgtttcaacatttccatcaccccagaaactccccttgtacccccttccacttcgtctcccctagctcctagaagcaaccactgatgtgatttctaccaaatccagttttggtcctactaaatatactcttttgagactggcctcttttactcaccataatgcctttgtaattcatccatgctgttgtgtgtatcagcagtttgttccttttcattgctgagtagtattctattgtagagatgtaccacagtttgtttattcttctgttgatggacgtttgggttgtttctaattttgaatgattataaataaaaattctgtgagtgttcttgtacgt

SEQ ID NO: 280481 - DNA, 584 bp, Homo sapiens
ccccaaggctttgagtacaagtcaggacagtgggtgcggatcgcctgcctggctctggggaccaccgagtaccaccccttcacactgacctccgcgccccatgaggacacactcagcctgcacatccgggcagtggggccctggaccactcgcctcagggagatctactcatccccaaagggcaatggctgtgctggatacccaaaggtgcccgtcactgggaaccctgcttccgggcctctggcactggcagaggatctctgcccttccctatcctgagactagaagctccagccgtcccaaagccagcctgggagaggaccggggtgcctcagaaaagactaggatgttctgtatcctccctctgcctgtgtctccgtttctggtctcagagctggggcagggtcaggctcatttcatctcccccctctcttggcagctgtaccttgatggaccgtttggagagggccatcaggagtggcataaatttgaggtgtcagtgttggtgggagggggcattggggtcaccccctttgcctccatcctcaaagacctggtcttcaagtcatccttgggcagccaaa

SEQ ID NO: 280482 - DNA, 1440 bp, Homo sapiens
tgctaggacagccgcggacggcccgcctccccgtgccccgggcctcgaggccaataaaaagctcgcccctccagctcaccgggtccgacgggtacggtacaaagtgctgtctctcgccacagccacctttgtgacaataaaagcaataaggctaatgtccatggggcgctcacggtgagctttagctttatgataaagattggcctgttacctcgtttaatcttcacaactgccccatcaactatgtactcttactgtccccagtttatgcatgaacagagaaagctgagatacggagactagtgatccgtcgaggtaataaacggcacaggtggggtttgaactccatcagtttgattgcagaggcctggaacaaccctacagccttctctcagatcttttctggacctttttctatgcgctttgcacctaggacgtgaggctgccaagcttggtattcaataaatattgatggatgaaggaacaatggaagaaaggagtgcatgggtaaacaaatgacaaatatgtcaaagcacggatgcagattcttagaatgggctaatgctgttttctgctggatttttggatgtgtacaaacgagttctctcacaatacagatccacagtgcctgggtcagaggagaactgatgctccgcatggcattttaccatcccgcctgcctgcctggggccctgggcccacaggctttggggagagtgtatggccaggctgcagccttcctgggataaagctctgccttttagtctcttatcctactttttagaagccctttaaggtctttgttaaaggaaatctaatgtgaagaattccaggagaactggataagcctgactatgggtgggcgtgactgaattacttcccgggctggctaaggaaggcctcccccgaagtgcatcggaagcctgcagcttctccttatggccactggagggcacttggaccatgaaataccagatcgtctcggcgtcccaggtctttggaaatgtgtgattcaattcagcaaacgtttcaaaatcatcactataaagatagcgcttttgtgttgaacatccaatatggcgctaaacaccttatatatatgtgtgcgtgtatatatgaacttgcttaatattaactacaattgttgtgagttacttaggctatttaggaaaaaaaaatcaaggcttaaagaagtcaaagtacttacccaagattgcttagctaaataaaatttgggagtaaggacttgaactcaagcccttgggcaccaaccataagcaataggtgcacacaaagctgaaatgaggactctcttataagcaggaagacgcacacaccacacaaatattattgttcctcaacaatttacacattctgaaattggaagatgacttacaatttgtacattacatggtaatgtttcttttttcccttgaaatg

SEQ ID NO: 280483 - DNA, 837 bp, Homo sapiens
cagggcatgcatgccacgcggactgtgacagtgagctcttccaggcccccagtgagcctgagagggggtctgggaagagtcaagagacacccagacagtgccatgtggcagtgaagcctctggtcccaatctgccagggtgcaaagccccaggactgctggtgggatgttggcactaccccgttttccttttccagctacaacagaatggcagagaggaaaggaccctccgggatcttccagttcagccagcccattttacagaggtggagactgaggccagaggcttgtcccaggaggctccatatgacgcagcaatcctcacccctctggcatcaacatttcttccaaccccaggagaggaaggtgtaacttgagtctctgcctaactcttgaggctgcagagatgtgtcctcccacagaggagatgaaaccaccaaggagctgtggacaagcggactcaggaaagctgtgagaaggcagacgaatgtgcggaggccagcgcccgggggcctccagtctggtgcctaaggtctgtgaacaagactgctgccggggcctcggtggggagatgcgcacagtgggcatctggggccacctccctgaaggcactggccaagccccgccccagcatccctcgctcactggatggtgcacttgtccctctcacgggcctggccttcccgaaggaccttggccttgatgtacttgaggtcactgttgacgctggggcggcgggcgaagggcgagaccatgccataggcgtccatctccttgacgcggcgcatgcagaagggcctggggtggaaggcgtcaccgtactgcacggagatcttgc

SEQ ID NO: 280484 - DNA, 1719 bp, Homo sapiens
tgaccggcccagcccacgtgactacaggggcacttgatgggaatcatggcagcatccaggccattgtcccgcttctgggagtggggaaagaacatcgtctgcgtggggaggaactacgcggaccacgtcagggagatgcgcagcgcggtgttgagcgagcccgtgctgttcctgaagccgtccacggcctacgcgcccgagggctcgcccatcctcatgcccgcgtacactcgcaacctgcaccacgagctggagctgggcgtggtgatgggcaagcgctgccgcgcagtccccgaggctgcggccatggactacgtgggcggctatgccctgtgcctggatatgaccgcccgggacgtgcaggacgagtgcaagaagaaggggctgccctggactctggcgaagagcttcacggcgtcctgcccggtcagcgcgttcgtgcccaaggagaagatccctgaccctcacaagctgaagctctggctcaaggtcaacggcgaactcagacaggagggtgagacatcctccatgattttttccatcccctacatcatcagctatgtttctaagatcataaccttggaagaaggagatattatcttgactgggacgccaaagggagttggaccggttaaagaaaacgatgagatcgaggctggcatacacgggctggtcagtatgacatttaaagtggaaaagccagaatattgagttatttcttaacaagtttcgagagagaagggagcaagacaagagcaagcaacggctattaaatgtcacaatcctttaattagaaaccatttattggccggacgcggtggctcacgcctgtaatcgcagcactttgggaggccgaggcgggcggctcacgacgtcaggagatccagaccatcttggctaacagggtgaaaccccgtctctactaaaaatacaaaaaattagccgggcgtggtggcgggcgcctgtagtcccagctactctggaggctgaggcaggagaatcaattgaacccgggaggcggagcttacagtgagctgagattgcgccactgtactcctgggcaacagcgagactccgtctcaaaaaaaaaaaaaaaaaaaaagaaaccatttattttaaaaatgattagattgctatgcctcaactcatagaagatgaacccttcaagaaaacgtgaagtagaacgggtgggccagaaatgaaaacaggcaagtaaagtatttcttcggaaaacattttatcaaaccaaatgttaaaaagactttccttttgtaaaactggattagagaagacttttcagtgggttatctctaggatgatcagtagttcagcacttaaaaactgcagagaaaactgaaagttatgttccagataactttccgttgtttaccaaattttcttagatttggtcatcatcaggaagcatttgtaaaaataaaaatctccacaaattactggcccatctcggacttgctgaatcaatttgataggattaatctccagtgaagctgtgtttacagggcattccaagtgattcttatcaggaaatgtgaaaaacactcctgtacataatcggttaatttaaaattttacttaataagtgaacaagtaatgaagatttcacctgtttacttagggtatctacccagacccatcgattctgagttcgggagatgattttgaaattactgttttccaaataaaggtgctcccttctaa

SEQ ID NO: 280485 - DNA, 311 bp, Homo sapiens
  misc_feature (41)..(41): n is a, c, g, or t
gctgtgtttacaggagattaatcctatcaaattgattcagnaagtccgagatgggccagtaattgctgaatcaatttgataggattaatctccagtgaagctgtgtttacagggcattccaagtgattcttatcaggaaatgtgaaaaacactcctgtacataatcggttaatttaaaattttacttaataagtgaacaagtaatgaagatttcacctgtttacttagggtatctacccagacccatcgattctgagttcgggagatgattttgaaattactgttttccaaataaaggtgctcccttctaa

SEQ ID NO: 280486 - DNA, 1882 bp, Homo sapiens
  misc_feature (1731)..(1731): n is a, c, g, or t
tgaccggcccagcccacgtgactacaggggcacttgatgggaatcatggcagcatccaggccattgtcccgcttctgggagtggggaaagaacatcgtctgcgtggggaggaactacgcggaccacgtcagggagatgcgcagcgcggtgttgagcgagcccgtgctgttcctgaagccgtccacggcctacgcgcccgagggctcgcccatcctcatgcccgcgtacactcgcaacctgcaccacgagctggagctgggcgtggtgatgggcaagcgctgccgcgcagtccccgaggctgcggccatggactacgtgggcggctatgccctgtgcctggatatgaccgcccgggacgtgcaggacgagtgcaagaagaaggggctgccctggactctggcgaagagcttcacggcgtcctgcccggtcagcgcgttcgtgcccaaggagaagatccctgaccctcacaagctgaagctctggctcaaggtcaacggcgaactcagacaggagggtgagacatcctccatgattttttccatcccctacatcatcagctatgtttctaagatcataaccttggaagaaggagatattatcttgactgggacgccaaagggagttggaccggttaaagaaaacgatgagatcgaggctggcatacacgggctggtcagtatgacatttaaagtggaaaagccagaatattgagttatttcttaacaagtttcgagagagaagggagcaagacaagagcaagcaacggctattaaatgtcacaatcctttaattagaaaccatttattggccggacgcggtggctcacgcctgtaatcgcagcactttgggaggccgaggcgggcggctcacgacgtcaggagatccagaccatcttggctaacagggtgaaaccccgtctctactaaaaatacaaaaaattagccgggcgtggtggcgggcgcctgtagtcccagctactctggaggctgaggcaggagaatcaattgaacccgggaggcggagcttacagtgagctgagattgcgccactgtactcctgggcaacagcgagactccgtctcaaaaaaaaaaaaaaaaaaaaagaaaccatttattttaaaaatgattagattgctatgcctcaactcatagaagatgaacccttcaagaaaacgtgaagtagaacgggtgggccagaaatgaaaacaggcaagtaaagtatttcttcggaaaacattttatcaaaccaaatgttaaaaagactttccttttgtaaaactggattagagaagacttttcagtgggttatctctaggatgatcagtagttcagcacttaaaaactgcagagaaaactgaaagttatgttccagataactttccgttgtttaccaaattttcttagatttggtcatcatcaggaagcatttgtaaaaataaaaatctccacaaattactggcccatctcggacttgctgaatcaatttgataggattaatctccagtgaagctgtgtttacagggcattccaagtgattcttatcaggaaatgtgaaaaacactcctgtacataatcggttaatttaaaattttacttaataagtgaacaagtaatgaagatttcacctgtttacttagggtatctacccagacccatcgattctgagttcgggagatgattttgaaattactgttttccaaataaaggtgctcccttctaaaaaaaaaaaaanaaaaaaaaaaaaaaaattttttgggggggatgggcctcgggaaaaatttttttaaaaaactttgtttgggggggggggccacttatgggttatggaaaattgggcaaaaagggtgttctaaggaaaactcggggcataaaaagggggtgga

SEQ ID NO: 280487 - DNA, 1196 bp, Homo sapiens
caggcggtccacatgattgtcacgctccgatcagctatgtttctaagatcataaccttggaagaaggagatattatcttgactgggacgccaaagggagttggaccggttaaagaaaacgatgagatcgaggctggcatacacgggctggtcagtatgacatttaaagtggaaaagccagaatattgagttatttcttaacaagtttcgagagagaagggagcaagacaagagcaagcaacggctattaaatgtcacaatcctttaattagaaaccatttattggccggacgcggtggctcacgcctgtaatcgcagcactttgggaggccgaggcgggcggctcacgacgtcaggagatccagaccatcttggctaacagggtgaaaccccgtctctactaaaaatacaaaaaattagccgggcgtggtggcgggcgcctgtagtcccagctactctggaggctgaggcaggagaatcaattgaacccgggaggcggagcttacagtgagctgagattgcgccactgtactcctgggcaacagcgagactccgtctcaaaaaaaaaaaaaaaaaaaaagaaaccatttattttaaaaatgattagattgctatgcctcaactcatagaagatgaacccttcaagaaaacgtgaagtagaacgggtgggccagaaatgaaaacaggcaagtaaagtatttcttcggaaaacattttatcaaaccaaatgttaaaaagactttccttttgtaaaactggattagagaagacttttcagtgggttatctctaggatgatcagtagttcagcacttaaaaactgcagagaaaactgaaagttatgttccagataactttccgttgtttaccaaattttcttagatttggtcatcatcaggaagcatttgtaaaaataaaaatctccacaaattactggcccatctcggacttgctgaatcaatttgataggattaatctccagtgaagctgtgtttacagggcattccaagtgattcttatcaggaaatgtgaaaaacactcctgtacataatcggttaatttaaaattttacttaataagtgaacaagtaatgaagatttcacctgtttacttagggtatctacccagacccatcgattctgagttcgggagatgattttgaaattactgttttccaaataaaggtgctcccttctaa

SEQ ID NO: 280488 - DNA, 2214 bp, Homo sapiens
  misc_feature (1731)..(1731): n is a, c, g, or t
tgaccggcccagcccacgtgactacaggggcacttgatgggaatcatggcagcatccaggccattgtcccgcttctgggagtggggaaagaacatcgtctgcgtggggaggaactacgcggaccacgtcagggagatgcgcagcgcggtgttgagcgagcccgtgctgttcctgaagccgtccacggcctacgcgcccgagggctcgcccatcctcatgcccgcgtacactcgcaacctgcaccacgagctggagctgggcgtggtgatgggcaagcgctgccgcgcagtccccgaggctgcggccatggactacgtgggcggctatgccctgtgcctggatatgaccgcccgggacgtgcaggacgagtgcaagaagaaggggctgccctggactctggcgaagagcttcacggcgtcctgcccggtcagcgcgttcgtgcccaaggagaagatccctgaccctcacaagctgaagctctggctcaaggtcaacggcgaactcagacaggagggtgagacatcctccatgattttttccatcccctacatcatcagctatgtttctaagatcataaccttggaagaaggagatattatcttgactgggacgccaaagggagttggaccggttaaagaaaacgatgagatcgaggctggcatacacgggctggtcagtatgacatttaaagtggaaaagccagaatattgagttatttcttaacaagtttcgagagagaagggagcaagacaagagcaagcaacggctattaaatgtcacaatcctttaattagaaaccatttattggccggacgcggtggctcacgcctgtaatcgcagcactttgggaggccgaggcgggcggctcacgacgtcaggagatccagaccatcttggctaacagggtgaaaccccgtctctactaaaaatacaaaaaattagccgggcgtggtggcgggcgcctgtagtcccagctactctggaggctgaggcaggagaatcaattgaacccgggaggcggagcttacagtgagctgagattgcgccactgtactcctgggcaacagcgagactccgtctcaaaaaaaaaaaaaaaaaaaaagaaaccatttattttaaaaatgattagattgctatgcctcaactcatagaagatgaacccttcaagaaaacgtgaagtagaacgggtgggccagaaatgaaaacaggcaagtaaagtatttcttcggaaaacattttatcaaaccaaatgttaaaaagactttccttttgtaaaactggattagagaagacttttcagtgggttatctctaggatgatcagtagttcagcacttaaaaactgcagagaaaactgaaagttatgttccagataactttccgttgtttaccaaattttcttagatttggtcatcatcaggaagcatttgtaaaaataaaaatctccacaaattactggcccatctcggacttgctgaatcaatttgataggattaatctccagtgaagctgtgtttacagggcattccaagtgattcttatcaggaaatgtgaaaaacactcctgtacataatcggttaatttaaaattttacttaataagtgaacaagtaatgaagatttcacctgtttacttagggtatctacccagacccatcgattctgagttcgggagatgattttgaaattactgttttccaaataaaggtgctcccttctaaaaaaaaaaaaanaaaaaaaaaaaaaaaaaaaaaaaaaaaaaaaaaaaaaaaaaaaaaaaaaaaaaaaaaaaaaaaaaaaaaaaggcaggcgaacaaaacaaaagaaaaacaaaagagaggggccgccggccacagcactgcccccaccgcgtagaccacggacacgacgccgcacccaccactggccctgctatactaaatcacgcaccccttagcggatatgattctacaaaaacaccatctattgagcgagcaaacgcacgtactaaccccagacactcccgttggtgaaacaaaggacactccttcatagtcctagctcgttcaataacctagtctcacacacatctctccgacgcagattatacacgacgaccacacacaatatcaaacataactcgacccggcgcactaggtataacaaccacctcatattcgtgccgtgtgacacaagctcgtctagtctgacttcatcaacaatccatcgtcgagcta

SEQ ID NO: 280489 - DNA, 515 bp, Homo sapiens
ctcgagccgccacgacggcccgagccggcacggacggccccaggagattcgtcacggaaacctcgccccaccaaggcggcccctaaagacaaaacggcccgcccgaggcttataggtggaagggacttgccttgtctcaggtgatgtctgatgaccctgacctgtcttcaggaaaaatcctgttagatcaggtccctgctgaagatgaggaggaagaattactggtgaaaacctgaagtttgaaaaagtaaatccaaattgctcttttgtctagtgttttgggaaacaaggaagagggaatgaaatctctgttttaaaattttattatttctgttattgcacattcacaattcactatatttcatgcattctttaaagatctaatttttttaattggatattgaatatctacaatgtgataactataaaacacctgtaaaacttaaataacaataccatgatacctatatattcaatatctagtttaagcataggctattattaccataacttcg

SEQ ID NO: 280490 - DNA, 2984 bp, Homo sapiens
ctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgcccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatttgtccttcatactatccatccataccacactatcttctgtatcaggtagtctaatagaaatatacctgttttgttctaaaa

SEQ ID NO: 280491 - DNA, 866 bp, Homo sapiens
tttttttaataatacaaatatattttatgaaataaacaaaaatgcatacaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatt

SEQ ID NO: 280492 - DNA, 578 bp, Homo sapiens
gagagagagagttagagagagagagagagagagagagagagagagagagagagagagagagagagagagagagagagagaactagttctctcctaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatt

SEQ ID NO: 280493 - DNA, 2413 bp, Homo sapiens
cttatgttctcgagtcgttatcggaattaaccagacaaatcgctccaccaactaagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatttgtccttcatactatccatccataccacactatcttctgtatcaggtagtctaatagaaatatacctgttttgttctaaaa

SEQ ID NO: 280494 - DNA, 2903 bp, Homo sapiens
ctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgcccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatt

SEQ ID NO: 280495 - DNA, 2940 bp, Homo sapiens
ctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgcccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctgctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatttgtccttcatactatccatccataccacactatcttctgtatcaggtagtctaatagaaatatacctgttttgttctaaaa

SEQ ID NO: 280496 - DNA, 1901 bp, Homo sapiens
  misc_feature (13)..(13): n is a, c, g, or t
  misc_feature (15)..(15): n is a, c, g, or t
  misc_feature (17)..(17): n is a, c, g, or t
  misc_feature (44)..(44): n is a, c, g, or t
  misc_feature (51)..(52): n is a, c, g, or t
  misc_feature (60)..(60): n is a, c, g, or t
ctcttgtatatcntncnataatagtctgtgcccatcgatagttntagcatnnaaacttcnggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatttgtccttcatactatccatccataccacactatcttctgtatcaggtagtctaatagaaatatacctgttttgttctaaaa

SEQ ID NO: 280497 - DNA, 2525 bp, Homo sapiens
tgttgtttaaattaaaagtgtttggagtctttaactatttttttttcccaacaataggtttatgctaaaactatcgatgggcaacagactattattgcatgtattgaaagccaccagtttcagcctaaaaacttctgctggtaagaagtagatattctcttctatttacatctgaaagaaaccagcagttgagacttggtttttaatccaactagcttggaataattatttaacttacagacttcagttttccatctataaatgagggatttagattccttacagttctaaggttttataattatattttcctttaaaagttactcttattttgagtgagaacaagtgattagtaaagtgccctgttgaaaatctgagttttacttggcttagggttactgctacttgagttaattgtgtaactcagcagcctattcatctgattttggaagagcctcccatgagcagaataggcatggttttccatttcaagggaaaaaaggaaaaatgaaagacaaaataacttagctttgggtttgccaaactggaaatgacagtttctctctctctctttttttttttctttttttgcacccctctttcccaacttctgtacctcagtggcaaatcacctctttcttgtgcttattgctaattctgcaatgttgtgtgtgtgttttaataggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatttgtccttcatactatccatccataccacactatcttctgtatcaggtagtctaatagaaatatacctgttttgttctaaaa

SEQ ID NO: 280498 - DNA, 1916 bp, Homo sapiens
ccattgtgaattaccactgcttatattaattatttgttcagagttggtaaaatggctcatcaacttaaagatagcttaaagcatggatttgtgtcctaaataacaggtttctctatgaacttcccctaaaaaggctcaaacattgtctcacacaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatttgtccttcatactatccatccataccacactatcttctgtatcaggtagtctaatagaaatatacctgttttgttctaaaa

SEQ ID NO: 280499 - DNA, 2575 bp, Homo sapiens
ctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgcccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaatagggatggttaaaaaaaaaacaccccttttttttttccccccctttttttttttttttttttccc

SEQ ID NO: 280500 - DNA, 2375 bp, Homo sapiens
ctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgcccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatttgtccttcatactatccatccataccacactatcttctgtatcaggtagtctaatagaaatatacctgttttgttctaaaa

SEQ ID NO: 280501 - DNA, 2195 bp, Homo sapiens
ctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgcccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaatttgttccaagtgacccattgagctgtgtatgcatttttgtttatttcaataaaatatatttgtattatttgtccttcatactatccatccataccacactatcttctgtatcaggtagtctaatagaaatatacctgttttgttctaaaa

SEQ ID NO: 280502 - DNA, 770 bp, Homo sapiens
  misc_feature (23)..(23): n is a, c, g, or t
tactgcaggtagaggcttactangaagtgtgaaaacgtaggcttggattaaggcgacagcgatttctaggatagtcagtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatttgtccttcatactatccatccataccacactatcttctgtatcaggtagtctaatagaaatatacctgttttgttctaaaa

SEQ ID NO: 280503 - DNA, 1209 bp, Homo sapiens
ctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgcccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaaacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatttgtccttcatactatccatccataccacactatcttctgtatcaggtagtctaatagaaatatacctgttttgttctaaaa

SEQ ID NO: 280504 - DNA, 354 bp, Homo sapiens
ctttgggagtttccccctcagtcagaaaaaaaaataaaaaaaagagagagagagagaaaaaaaaaaaaaaaaaaaaaaaaaaaaaaaaaaaaaaaaaaaaaaaaaccaagtagtgtcttcctacctatctccagatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatttgtccttcatactatccatccataccacactatcttctgtatcaggtagtctaatagaaatatacctgttttgttctaaaa

SEQ ID NO: 280505 - DNA, 968 bp, Homo sapiens
ctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgcccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttaattaagacctgatcttcatatcctctagttctagatcgcgatctagaactagtccccacgcgtccg

SEQ ID NO: 280506 - DNA, 3006 bp, Homo sapiens
ctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgcccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatcgtcatatcatatttatcgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatttgtccttcatactatccatccataccacactatcttctgtatcaggtagtctaatagaaatatacctgttttgttctaaaa

SEQ ID NO: 280507 - DNA, 3021 bp, Homo sapiens
ctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgcccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatttgtccttcatactatccatccataccacactatcttctgtatcaggtagtctaatagaaatatacctgttttgttctaaaaaaaaaaaaaaaaaaaacaaacaaaaaaaaaaaaaaaa

SEQ ID NO: 280508 - DNA, 2940 bp, Homo sapiens
ctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgcccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattattaaaaaaaaaaaaaaaacaaacaaaaaaaaaaaaaaaa

SEQ ID NO: 280509 - DNA, 2930 bp, Homo sapiens
ctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgcccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaagtgacccattgagctgtgtatgcatttttgtttatttcaataaaatatatttgtattatttgtccttcatactatccatccataccacactatcttctgtatcaggtagtctaatagaaatatacctgttttgttctaaaa

SEQ ID NO: 280510 - DNA, 2134 bp, Homo sapiens
  misc_feature (2098)..(2098): n is a, c, g, or t
  misc_feature (2122)..(2122): n is a, c, g, or t
ctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgcccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggagaccgggagcnggggcgtgcctcctcctccgagantctccgtcgact

SEQ ID NO: 280511 - DNA, 1434 bp, Homo sapiens
ctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgcccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacatagccttaagcggatcagcggtgatactctagag

SEQ ID NO: 280512 - DNA, 513 bp, Homo sapiens
tcattgaaaataatatatcctgtctatccttcacaggggactcaagcatatccattgactatagcattacttttctgttcacaaccagccccatttctgttcaagcaactcatcttcaattatctattgcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatcttttttttcttttttttt

SEQ ID NO: 280513 - DNA, 847 bp, Homo sapiens
agcggatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgacggcaagcctgtcttgttgctgttgagaatgcgtggcgcaaagctcaagaagtctgtaaccttgttggccaaaccttaggaaaacctttactaatcaaagaagaagaaacaaaagaatgggaaggccaaatagatgatcaccagtcatccagactctcaagttcattaactgtacaacaaaaaatcaaaagtgcaacaatacatgctgcttcaaaagtatttataacttttgaggtaaagggaaaagagaagagaaaaaagcacctttgaaattccaaacaaattatattgtacttgtatcttttt

SEQ ID NO: 280514 - DNA, 538 bp, Homo sapiens
gtgaatatttgacccattcttctcctagacgaaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgacggcaagcctgtcttgttgctgttgagaatgcgtggcgcaaagctcaagaagtctgtaaccttgttggccaaaccttaggaaaacctttactaatcaaagaagaagaaacaaaagaatgggaaggccaaatagatgatcaccagtcatccagactctcaagttcattaactgtacaacaaaaaatcaaaagtgcaacaatacatgctgcttcaaaagtatttataacttttgaggtaaagggaaaagagaagagaaaaaagcacctttgaaattccaaacaaattatattgtacttgtatcttttt

SEQ ID NO: 280515 - DNA, 645 bp, Homo sapiens
agcggatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagagttccattaatccagaacgaatgggtttcctccctgcaacctgtcaatcaaacagaggtggccaatcaccactctgaattttttgctctcagtgcttcttcagactatgttccagttgaaaacttctttagcagtgttctgaaagaggtaaaaattctaccctatctaaagcacatctagggactgaatttcagaaacaactaaaatagggagttgactccctaacaaataacaact

SEQ ID NO: 280516 - DNA, 557 bp, Homo sapiens
ttttcttttgagacagggtctcattctgtttaccaggatggagtgcagtggcacaataatagctcattgcagtaaatttatcaactaatacagatgtgtgacttttaagtgggcaacctgaaaagtggatataaatgctgattccaacaaaagcattatttataataaggatctactgtatcttgaaagatacaagtaataccttaccttgctcaatgacagctgatgactttgaaagagtggacgcctttgggagtacagatgacttcattttacgtttgactggcttttccttttccatgttttcttttgcagaattattcctagtgccatgactaaaactggattgaccaggactggaaagagtattcaaagctttggaatgtttcacagaattctctagtactaaaacatacaaacaaaatttaaaaattaagagttattgaacctaaagataagaaaaaaggttaacctgaattatttgaattagccaagacaacaaaacctgaaggatgcttaaagctttcttaggaaagctactttctaataggaaaaag

SEQ ID NO: 280517 - DNA, 3390 bp, Homo sapiens
aaaaaaagacctatataaattagtttaagctaacatttagacatttactattacatatatggtatttgcaaccaaatcactgagtttgttgttgtcgttgtttgaggctgttgctctgtcacccaggatggagtgcaagtagctcaatcatagcttactgcagcctaaaaactcctgggctgaagaaatcctctcacctcagccttttaagtagctgaaacattaggtgcacaccaccaggcctggctaattttttattagtgataaggtcttgctatgttgcccaggctggtctcaaactcctggcttcaagcagtcctgcctcagcttcccagagtgctggactacaggcatgagccactgcacccagccccaaatagcttctactcataacctagtgtggcctaaatttatttaaaatgcccgggtaggccaggcacgttggctcacgcctgtaatcccagcacttgggaggccgaggtaggcagatcacttgaggtcaggagttcgagaccaacctggccaatatattgaaaccctgtctcttctaaaaatacagaagttactcaggcgtggtggcgtgtgactgtaatctcagctaccggggaggctgaagcagaagaaacgctcgaacctgggaggcagagcttacagtgagccgagatcgcaccactgcacttcagcctgggtgacaaagtgagactccatctacatacatacatacatacatacatacatacatacataaaatgcccagtatcttacaagactgtagttcacagtgggtaattcaaatcagacactgctcttcaagagaggtaatattaatagaaatctttcaagaaggattgttttctactattaaaacaataaaactcttataaacctgtttatcagaaggatatttctgtttcagcaactcctggaatccttcttcaacatcccaaccaacaattactcccagatagccatgtcacctgtgaattatcatgaatcccacatcaaataaacaaatactgcctctggactctaaattgcacatttttgagaaaatatttatgcaaagtgttccactgaaatgtatctcttacgaaagtatctgaatagtgaagtatttatcactcatcacagtaacttacggtaagaaatcaataaaattgttttattaaatgtacacataaaaaggcatataagtttttgaccttcagttgttttggaattaaattacatttcggcacccaaatatcttttaactgacagttttcacactttgcaaaacacacagggcactggaaactctaatgaaccagcatttacataatggtatctgccatatgaccactttggtaagcagcttgttgagattatgtactaagtgctttatgtgatgccaaaaaactttaaaaagcaaataataaatcatgaggctctacaaaatagcttagaaaaacaagttttctatttatttaaaaataagtttgtagttactacattgcagggacaggtattcttacacatacattctagtttgtataaaaggattcaaagaattatgcatcaaaactaacatagaaagtgtccacgtaacagtaaagaaaggtccaatcagtatgtacaaaaagaaagggcactgctattctggtgtgaaactgctgtttataatatgatactccaggttcggaaggaaaaaaacaaacttcaataaagctaaataattaatttgttttaaaactctgtgttacttattacatacaacagatctgcttgtgtttaaacattgttttctgtacaaaataagcataatcttaatttgaaaatgtgtcagtttcaactttcaccctctaggtcagttactttttaaaaattgagctacattctacacatgtctaaatatcctgtgacaggatttaagttttctaaaagatcttcagtaagacccctgtcttcttgcagttttaatatggtccaaaaatgtaactttgtattgtctcatgttatagtctatcattgtgactaatcaacacacacaatcttaaagtaaccagcatgtgtgcatctgccttatatgcatgtactatattccatcttgaacctattttcttggctccttgaattgtagaaactcagccatgcactaagtatttggtctgtgccataaggttaatttcctgataatttttatctgcattaaaaaagtatttcaacacagagctatcaaaactaaaaataatatctatttatagctcatattttctactcactgttctactgcagtgtgtacaaggtttatctctggagcgccaaaagtggtacttacagtcttctgactcaatttgaccttttcttgggtactatacatagttcgtaatgacttttcatttggagcaaactttgctcagtataattaacaaaaatagtttcttagtaagtgtaatattaattttagttcagatcacttggaaattaggggaactaagggaaactgcaagggtagaagcaaagaaaagtgtatttttcaaattttaatgggaaaataaattcttgcctaagtgtaacaaaaccactgctcaatctgttatgttagaaatactttttaggttaataggagtaatcagatgataaaactacttcccctattatgacttttaaaatcatgtaactcctgcatataagcagaacacttacagtcctttaatcactcaagtatcttggtcctttcaacctactcaaaaataaatttcaggtaacaaaaacattcagaatatatccgttttcattagatagaaaactgaaaaagttgcttctagctgacatttgagagagatatacagtaggtatatatgtataaaatggaatgtcagaattgaagtaaacattgttaactggagaaattaatttatattacaaatcatatctgaaaacatgtaaatgctgctaacatataagataaaaatatttgaatacatttcttaaaatgtctgattcctctactgcactgcagatgagggacagttctagatgttaacatacatgctgcataaagatattttctctgattactgtatcttatgtaattcatttccaagtgataactaaatttagtcaatcccaagtctcagatgttacctaatccagctcacaaatattccacatacttatttacttggattggaggaagacagttttataataatgccagcagtctttaaatttgtagtgaagttgtgcaataaaaacaattgaaataaggccaatctttagtttataatacatgcagaaaatagtccaatgccactatagcaggtcacaaaggataaaattttaaaaagctatgtatctattgcccagggctgtgagtctctgattagactaaatatttaaactaatgct

SEQ ID NO: 280518 - DNA, 3476 bp, Homo sapiens
aggtttaagggaaactccttcaatttcatttaaaaatccctggtttaaaatataagttttttaatattcaagacaatattagataaatttgaaaattcaaaagcaaaaatcttaaagaacaaaataatttagttataagtatcaaataggcttttaaaaatctgttacatactataaaatgacctcatagtctggctatactttttttacttacatgtagagaaaatcttgaaacagtacatcagacatgaaaataatatcgtgtcatttcatttacaggtctgcattacatttactgaatttggaaaaatgcaaaatatttgtaactttcttgttgaaaagctagatagctctgttgtcatcagcccaccccagttctatcatactccaggttctgttgagaatcttcgacggcaagcctgtcttgttgctgttgagaatgcgtggcgcaaagctcaagaagtctgtaaccttgttggccaaaccttaggaaaacctttactaatcaaagaagaagaaacaaaagaatgggaaggccaaatagatgatcaccagtcatccagactctcaagttcattaactgtacaacaaaaaatcaaaagtgcaacaatacatgctgcttcaaaagtatttataacttttgagaagttactcaggcgtggtggcgtgtgactgtaatctcagctaccggggaggctgaagcagaagaaacgctcgaacctgggaggcagagcttacagtgagccgagatcgcaccactgcacttcagcctgggtgacaaagtgagactccatctacatacatacatacatacatacatacatacatacataaaatgcccagtatcttacaagactgtagttcacagtgggtaattcaaatcagacactgctcttcaagagaggtaatattaatagaaatctttcaagaaggattgttttctactattaaaacaataaaactcttataaacctgtttatcagaaggatatttctgtttcagcaactcctggaatccttcttcaacatcccaaccaacaattactcccagatagccatgtcacctgtgaattatcatgaatcccacatcaaataaacaaatactgcctctggactctaaattgcacatttttgagaaaatatttatgcaaagtgttccactgaaatgtatctcttacgaaagtatctgaatagtgaagtatttatcactcatcacagtaacttacggtaagaaatcaataaaattgttttattaaatgtacacataaaaaggcatataagtttttgaccttcagttgttttggaattaaattacatttcggcacccaaatatcttttaactgacagttttcacactttgcaaaacacacagggcactggaaactctaatgaaccagcatttacataatggtatctgccatatgaccactttggtaagcagcttgttgagattatgtactaagtgctttatgtgatgccaaaaaactttaaaaagcaaataataaatcatgaggctctacaaaatagcttagaaaaacaagttttctatttatttaaaaataagtttgtagttactacattgcagggacaggtattcttacacatacattctagtttgtataaaaggattcaaagaattatgcatcaaaactaacatagaaagtgtccacgtaacagtaaagaaaggtccaatcagtatgtacaaaaagaaagggcactgctattctggtgtgaaactgctgtttataatatgatactccaggttcggaaggaaaaaaacaaacttcaataaagctaaataattaatttgttttaaaactctgtgttacttattacatacaacagatctgcttgtgtttaaacattgttttctgtacaaaataagcataatcttaatttgaaaatgtgtcagtttcaactttcaccctctaggtcagttactttttaaaaattgagctacattctacacatgtctaaatatcctgtgacaggatttaagttttctaaaagatcttcagtaagacccctgtcttcttgcagttttaatatggtccaaaaatgtaactttgtattgtctcatgttatagtctatcattgtgactaatcaacacacacaatcttaaagtaaccagcatgtgtgcatctgccttatatgcatgtactatattccatcttgaacctattttcttggctccttgaattgtagaaactcagccatgcactaagtatttggtctgtgccataaggttaatttcctgataatttttatctgcattaaaaaagtatttcaacacagagctatcaaaactaaaaataatatctatttatagctcatattttctactcactgttctactgcagtgtgtacaaggtttatctctggagcgccaaaagtggtacttacagtcttctgactcaatttgaccttttcttgggtactatacatagttcgtaatgacttttcatttggagcaaactttgctcagtataattaacaaaaatagtttcttagtaagtgtaatattaattttagttcagatcacttggaaattaggggaactaagggaaactgcaagggtagaagcaaagaaaagtgtatttttcaaattttaatgggaaaataaattcttgcctaagtgtaacaaaaccactgctcaatctgttatgttagaaatactttttaggttaataggagtaatcagatgataaaactacttcccctattatgacttttaaaatcatgtaactcctgcatataagcagaacacttacagtcctttaatcactcaagtatcttggtcctttcaacctactcaaaaataaatttcaggtaacaaaaacattcagaatatatccgttttcattagatagaaaactgaaaaagttgcttctagctgacatttgagagagatatacagtaggtatatatgtataaaatggaatgtcagaattgaagtaaacattgttaactggagaaattaatttatattacaaatcatatctgaaaacatgtaaatgctgctaacatataagataaaaatatttgaatacatttcttaaaatgtctgattcctctactgcactgcagatgagggacagttctagatgttaacatacatgctgcataaagatattttctctgattactgtatcttatgtaattcatttccaagtgataactaaatttagtcaatcccaagtctcagatgttacctaatccagctcacaaatattccacatacttatttacttggattggaggaagacagttttataataatgccagcagtctttaaatttgtagtgaagttgtgcaataaaaacaattgaaataaggccaatctttagtttataatacatgcagaaaatagtccaatgccactatagcaggtcacaaaggataaaattttaaaaagctatgtatctattgcccagggctgtgagtctctgattagactaaatatttaaactaatgct

SEQ ID NO: 280519 - DNA, 3240 bp, Homo sapiens
agcggatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagagaagttactcaggcgtggtggcgtgtgactgtaatctcagctaccggggaggctgaagcagaagaaacgctcgaacctgggaggcagagcttacagtgagccgagatcgcaccactgcacttcagcctgggtgacaaagtgagactccatctacatacatacatacatacatacatacatacatacataaaatgcccagtatcttacaagactgtagttcacagtgggtaattcaaatcagacactgctcttcaagagaggtaatattaatagaaatctttcaagaaggattgttttctactattaaaacaataaaactcttataaacctgtttatcagaaggatatttctgtttcagcaactcctggaatccttcttcaacatcccaaccaacaattactcccagatagccatgtcacctgtgaattatcatgaatcccacatcaaataaacaaatactgcctctggactctaaattgcacatttttgagaaaatatttatgcaaagtgttccactgaaatgtatctcttacgaaagtatctgaatagtgaagtatttatcactcatcacagtaacttacggtaagaaatcaataaaattgttttattaaatgtacacataaaaaggcatataagtttttgaccttcagttgttttggaattaaattacatttcggcacccaaatatcttttaactgacagttttcacactttgcaaaacacacagggcactggaaactctaatgaaccagcatttacataatggtatctgccatatgaccactttggtaagcagcttgttgagattatgtactaagtgctttatgtgatgccaaaaaactttaaaaagcaaataataaatcatgaggctctacaaaatagcttagaaaaacaagttttctatttatttaaaaataagtttgtagttactacattgcagggacaggtattcttacacatacattctagtttgtataaaaggattcaaagaattatgcatcaaaactaacatagaaagtgtccacgtaacagtaaagaaaggtccaatcagtatgtacaaaaagaaagggcactgctattctggtgtgaaactgctgtttataatatgatactccaggttcggaaggaaaaaaacaaacttcaataaagctaaataattaatttgttttaaaactctgtgttacttattacatacaacagatctgcttgtgtttaaacattgttttctgtacaaaataagcataatcttaatttgaaaatgtgtcagtttcaactttcaccctctaggtcagttactttttaaaaattgagctacattctacacatgtctaaatatcctgtgacaggatttaagttttctaaaagatcttcagtaagacccctgtcttcttgcagttttaatatggtccaaaaatgtaactttgtattgtctcatgttatagtctatcattgtgactaatcaacacacacaatcttaaagtaaccagcatgtgtgcatctgccttatatgcatgtactatattccatcttgaacctattttcttggctccttgaattgtagaaactcagccatgcactaagtatttggtctgtgccataaggttaatttcctgataatttttatctgcattaaaaaagtatttcaacacagagctatcaaaactaaaaataatatctatttatagctcatattttctactcactgttctactgcagtgtgtacaaggtttatctctggagcgccaaaagtggtacttacagtcttctgactcaatttgaccttttcttgggtactatacatagttcgtaatgacttttcatttggagcaaactttgctcagtataattaacaaaaatagtttcttagtaagtgtaatattaattttagttcagatcacttggaaattaggggaactaagggaaactgcaagggtagaagcaaagaaaagtgtatttttcaaattttaatgggaaaataaattcttgcctaagtgtaacaaaaccactgctcaatctgttatgttagaaatactttttaggttaataggagtaatcagatgataaaactacttcccctattatgacttttaaaatcatgtaactcctgcatataagcagaacacttacagtcctttaatcactcaagtatcttggtcctttcaacctactcaaaaataaatttcaggtaacaaaaacattcagaatatatccgttttcattagatagaaaactgaaaaagttgcttctagctgacatttgagagagatatacagtaggtatatatgtataaaatggaatgtcagaattgaagtaaacattgttaactggagaaattaatttatattacaaatcatatctgaaaacatgtaaatgctgctaacatataagataaaaatatttgaatacatttcttaaaatgtctgattcctctactgcactgcagatgagggacagttctagatgttaacatacatgctgcataaagatattttctctgattactgtatcttatgtaattcatttccaagtgataactaaatttagtcaatcccaagtctcagatgttacctaatccagctcacaaatattccacatacttatttacttggattggaggaagacagttttataataatgccagcagtctttaaatttgtagtgaagttgtgcaataaaaacaattgaaataaggccaatctttagtttataatacatgcagaaaatagtccaatgccactatagcaggtcacaaaggataaaattttaaaaagctatgtatctattgcccagggctgtgagtctctgattagactaaatatttaaactaatgct

SEQ ID NO: 280520 - DNA, 3553 bp, Homo sapiens
agcggatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgacggcaagcctgtcttgttgctgttgagaatgcgtggcgcaaagctcaagaagtctgtaaccttgttggccaaaccttaggaaaacctttactaatcaaagaagaagaaacaaaagaatgggaaggccaaatagatgatcaccagtcatccagactctcaagttcattaactgtacaacaaaaaatcaaaagtgcaacaatacatgctgcttcaaaagtatttataacttttgagaagttactcaggcgtggtggcgtgtgactgtaatctcagctaccggggaggctgaagcagaagaaacgctcgaacctgggaggcagagcttacagtgagccgagatcgcaccactgcacttcagcctgggtgacaaagtgagactccatctacatacatacatacatacatacatacatacatacataaaatgcccagtatcttacaagactgtagttcacagtgggtaattcaaatcagacactgctcttcaagagaggtaatattaatagaaatctttcaagaaggattgttttctactattaaaacaataaaactcttataaacctgtttatcagaaggatatttctgtttcagcaactcctggaatccttcttcaacatcccaaccaacaattactcccagatagccatgtcacctgtgaattatcatgaatcccacatcaaataaacaaatactgcctctggactctaaattgcacatttttgagaaaatatttatgcaaagtgttccactgaaatgtatctcttacgaaagtatctgaatagtgaagtatttatcactcatcacagtaacttacggtaagaaatcaataaaattgttttattaaatgtacacataaaaaggcatataagtttttgaccttcagttgttttggaattaaattacatttcggcacccaaatatcttttaactgacagttttcacactttgcaaaacacacagggcactggaaactctaatgaaccagcatttacataatggtatctgccatatgaccactttggtaagcagcttgttgagattatgtactaagtgctttatgtgatgccaaaaaactttaaaaagcaaataataaatcatgaggctctacaaaatagcttagaaaaacaagttttctatttatttaaaaataagtttgtagttactacattgcagggacaggtattcttacacatacattctagtttgtataaaaggattcaaagaattatgcatcaaaactaacatagaaagtgtccacgtaacagtaaagaaaggtccaatcagtatgtacaaaaagaaagggcactgctattctggtgtgaaactgctgtttataatatgatactccaggttcggaaggaaaaaaacaaacttcaataaagctaaataattaatttgttttaaaactctgtgttacttattacatacaacagatctgcttgtgtttaaacattgttttctgtacaaaataagcataatcttaatttgaaaatgtgtcagtttcaactttcaccctctaggtcagttactttttaaaaattgagctacattctacacatgtctaaatatcctgtgacaggatttaagttttctaaaagatcttcagtaagacccctgtcttcttgcagttttaatatggtccaaaaatgtaactttgtattgtctcatgttatagtctatcattgtgactaatcaacacacacaatcttaaagtaaccagcatgtgtgcatctgccttatatgcatgtactatattccatcttgaacctattttcttggctccttgaattgtagaaactcagccatgcactaagtatttggtctgtgccataaggttaatttcctgataatttttatctgcattaaaaaagtatttcaacacagagctatcaaaactaaaaataatatctatttatagctcatattttctactcactgttctactgcagtgtgtacaaggtttatctctggagcgccaaaagtggtacttacagtcttctgactcaatttgaccttttcttgggtactatacatagttcgtaatgacttttcatttggagcaaactttgctcagtataattaacaaaaatagtttcttagtaagtgtaatattaattttagttcagatcacttggaaattaggggaactaagggaaactgcaagggtagaagcaaagaaaagtgtatttttcaaattttaatgggaaaataaattcttgcctaagtgtaacaaaaccactgctcaatctgttatgttagaaatactttttaggttaataggagtaatcagatgataaaactacttcccctattatgacttttaaaatcatgtaactcctgcatataagcagaacacttacagtcctttaatcactcaagtatcttggtcctttcaacattagatagaaaactgaaaaagttgcttctagctgacatttgagagagatatacagtaggtatatatgtataaaatggaatgtcagaattgaagtaaacattgttaactggagaaattaatttatattacaaatcatatctgaaaacatgtaaatgctgctaacatataagataaaaatatttgaatacatttcttaaaatgtctgattcctctactgcactgcagatgagggacagttctagatgttaacatacatgctgcataaagatattttctctgattactgtatcttatgtaattcatttccaagtgataactaaatttagtcaatcccaagtctcagatgttacctaatccagctcacaaatattccacatacttatttacttggattggaggaagacagttttataataatgccagcagtctttaaatttgtagtgaagttgtgcaataaaaacaattgaaataaggccaatctttagtttataatacatgcagaaaatagtccaatgccactatagcaggtcacaaaggataaaattttaaaaagctatgtatctattgcccagggctgtgagtctctgattagactaaatatttaaactaatgct

SEQ ID NO: 280521 - DNA, 3552 bp, Homo sapiens
agcggatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgacggcaagcctgtcttgttgctgttgagaatgcgtggcgcaaagctcaagaagtctgtaaccttgttggccaaaccttaggaaaacctttactaatcaaagaagaagaaacaaaagaatgggaaggccaaatagatgatcaccagtcatccagactctcaagttcattaactgtacaacaaaaaatcaaaagtgcaacaatacatgctgcttcaaaagtatttataacttttgagaagttactcaggcgtggtggcgtgtgactgtaatctcagctaccggggaggctgaagcagaagaaacgctcgaacctgggaggcagagcttacagtgagccgagatcgcaccactgcacttcagcctgggtgacaaagtgagactccatctacatacatacatacatacatacatacatacatacataaaatgcccagtatcttacaagactgtagttcacagtgggtaattcaaatcagacactgctcttcaagagaggtaatattaatagaaatctttcaagaaggattgttttctactattaaaacaataaaactcttataaacctgtttatcagaaggatatttctgtttcagcaactcctggaatccttcttcaacatcccaaccaacaattactcccagatagccatgtcacctgtgaattatcatgaatcccacatcaaataaacaaatactgcctctggactctaaattgcacatttttgagaaaatatttatgcaaagtgttccactgaaatgtatctcttacgaaagtatctgaatagtgaagtatttatcactcatcacagtaacttacggtaagaaatcaataaaattgttttattaaatgtacacataaaaaggcatataagtttttgaccttcagttgttttggaattaaattacatttcggcacccaaatatcttttaactgacagttttcacactttgcaaaacacacagggcactggaaactctaatgaaccagcatttacataatggtatctgccatatgaccactttggtaagcagcttgttgagattatgtactaagtgctttatgtgatgccaaaaaactttaaaaagcaaataataaatcatgaggctctacaaaatagcttagaaaaacaagttttctatttatttaaaaataagtttgtagttactacattgcagggacaggtattcttacacatacattctagtttgtataaaaggattcaaagaattatgcatcaaaactaacatagaaagtgtccacgtaacagtaaagaaaggtccaatcagtatgtacaaaaagaaagggcactgctattctggtgtgaaactgctgtttataatatgatactccaggttcggaaggaaaaaaacaaacttcaataaagctaaataattaatttgttttaaaactctgtgttacttattacatacaacagatctgcttgtgtttaaacattgttttctgtacaaaataagcataattaaaaattgagctacattctacacatgtctaaatatcctgtgacaggatttaagttttctaaaagatcttcagtaagacccctgtcttcttgcagttttaatatggtccaaaaatgtaactttgtattgtctcatgttatagtctatcattgtgactaatcaacacacacaatcttaaagtaaccagcatgtgtgcatctgccttatatgcatgtactatattccatcttgaacctattttcttggctccttgaattgtagaaactcagccatgcactaagtatttggtctgtgccataaggttaatttcctgataatttttatctgcattaaaaaagtatttcaacacagagctatcaaaactaaaaataatatctatttatagctcatattttctactcactgttctactgcagtgtgtacaaggtttatctctggagcgccaaaagtggtacttacagtcttctgactcaatttgaccttttcttgggtactatacatagttcgtaatgacttttcatttggagcaaactttgctcagtataattaacaaaaatagtttcttagtaagtgtaatattaattttagttcagatcacttggaaattaggggaactaagggaaactgcaagggtagaagcaaagaaaagtgtatttttcaaattttaatgggaaaataaattcttgcctaagtgtaacaaaaccactgctcaatctgttatgttagaaatactttttaggttaataggagtaatcagatgataaaactacttcccctattatgacttttaaaatcatgtaactcctgcatataagcagaacacttacagtcctttaatcactcaagtatcttggtcctttcaacctactcaaaaataaatttcaggtaacaaaaacattcagaatatatccgttttcattagatagaaaactgaaaaagttgcttctagctgacatttgagagagatatacagtaggtatatatgtataaaatggaatgtcagaattgaagtaaacattgttaactggagaaattaatttatattacaaatcatatctgaaaacatgtaaatgctgctaacatataagataaaaatatttgaatacatttcttaaaatgtctgattcctctactgcactgcagatgagggacagttctagatgttaacatacatgctgcataaagatattttctctgattactgtatcttatgtaattcatttccaagtgataactaaatttagtcaatcccaagtctcagatgttacctaatccagctcacaaatattccacatacttatttacttggattggaggaagacagttttataataatgccagcagtctttaaatttgtagtgaagttgtgcaataaaaacaattgaaataaggccaatctttagtttataatacatgcagaaaatagtccaatgccactatagcaggtcacaaaggataaaattttaaaaagctatgtatctattgcccagggctgtgagtctctgattagactaaatatttaaactaatgct

SEQ ID NO: 280522 - DNA, 1473 bp, Homo sapiens
agcggatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgacggcaagcctgtcttgttgctgttgagaatgcgtggcgcaaagctcaagaagtctgtaaccttgttggccaaaccttaggaaaacctttactaatcaaagaagaagaaacaaaagaatgggaaggccaaatagatgatcaccagtcatccagactctcaagttcattaactgtacaacaaaaaatcaaaagtgcaacaatacatgctgcttcaaaagtatttataacttttgagaagttactcaggcgtggtggcgtgtgactgtaatctcagctaccggggaggctgaagcagaagaaacgctcgaacctgggaggcagagcttacagtgagccgagatcgcaccactgcacttcagcctgggtgacaaagtgagactccatctacatacatacatacatacatacatacatacatacataaaatgcccagtatcttacaagactgtagttcacagtgggtaattcaaatcagacactgctcttcaagagaggtaatattaatagaaatctttcaagaaggattgttttctactattaaaacaataaaactcttataaacctgtttatcagaaggatatttctgtttcagcaactcctggaatccttcttcaacatcccaaccaacaattactcccagatagccatgtcacctgtgaattatcatgaatcccacatcaaataaacaaatactgcctctggactctaaaagaaaaagaaaaaaaaaaaaacaaaccgttgcggcgcacaagaagccctcaaaaaacatctaaacaacctagaaagggacacagggcacacaggggacaacgaaacacgaggacacaacacagcatcacccagtaggacaaccgcggcacaacacaagaggcaggaactccaaccagtgacaacaacgccggggggaacacgcggaacggaacaaacccaagg

SEQ ID NO: 280523 - DNA, 443 bp, Homo sapiens
aaaaatgcaaaatatttgtaactttcttgttgaaaagctagatagctctgttgtcatcagcccaccccagttctatcatactccaggttctgttgagaatcttcggtaagtttaagcacatctttaactaagatattctttaaacaaaactatccagtgctacatttcattgagtgtcatattaataatctctccatttaattcctaagacggcaagcctgtcttgttgctgttgagaatgcgtggcgcaaagctcaagaagtctgtaaccttgttggccaaaccttaggaaaacctttactaatcaaagaagaagaaacaaaagaatgggaaggccaaatagatgatcaccagtcatccagactctcaagttcattaactgtacaacaaaaaatcaaaagtgcaacaatacatgctgcttcaaaagtatttataacttttga

SEQ ID NO: 280524 - DNA, 605 bp, Homo sapiens
gttgctgaaaggtaatttttcttggctggttcttctaagtatatactaggtattgttattagcagacttcataaagaaaaggttatcaggaattttttttaccttccttcctcaacttagaaatttattatatacaaaatcattttaacaaaacatcttagggagaaattaacacaaaattacaaatcactccatgtgcttaatttgaaatgttatggccttatgtattcatatctaatggtcttcatgctaaaattgggattcttagtcaataaaaatgcatgccaatctgacaaaatttctaggaaaactgcaataaccttctttccatcattccttttttcccagaaattgcacatttttgagaaaatatttatgcaaagtgttccactgaaatgtatctcttacgaaagtatctgaatagtgaagtatttatcactcatcacagtaacttacggtaagaaatcaataaaattgttttattaaatgtacacataaaaaggcatataagtttttgaccttcagttgttttggaattaaattacatttcggcacccaaatatcttttaactgacagttttcacactttgcaaaacacacagggc

SEQ ID NO: 280525 - DNA, 891 bp, Homo sapiens
agcggatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgaaattgcacatttttgagaaaatatttatgcaaagtgttccactgaaatgtatctcttacgaaagtatctgaatagtgaagtatttatcactcatcacagtaacttacgaattattcctagtgccatgactaaaactggattgaccaggactggaaagagtattcaaagctttggaatgtttcacagaattctctagtactaaaacatacaaacaaaatttaaaaattaagagttattgaacctaaagataagaaaaaaggttaacctgaattatttgaattagccaagacaacaaaacctgaaggatgcttaaagctttcttaggaaagctactttctaataggaaaaag

SEQ ID NO: 280526 - DNA, 3606 bp, Homo sapiens
agcggatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgacggcaagcctgtcttgttgctgttgagaatgcgtggcgcaaagctcaagaagtctgtaaccttgttggccaaaccttaggaaaacctttactaatcaaagaagaagaaacaaaagaatgggaaggccaaatagatgatcaccagtcatccagactctcaagttcattaactgtacaacaaaaaatcaaaagtgcaacaatacatgctgcttcaaaagtatttataacttttgagaagttactcaggcgtggtggcgtgtgactgtaatctcagctaccggggaggctgaagcagaagaaacgctcgaacctgggaggcagagcttacagtgagccgagatcgcaccactgcacttcagcctgggtgacaaagtgagactccatctacatacatacatacatacatacatacatacatacataaaatgcccagtatcttacaagactgtagttcacagtgggtaattcaaatcagacactgctcttcaagagaggtaatattaatagaaatctttcaagaaggattgttttctactattaaaacaataaaactcttataaacctgtttatcagaaggatatttctgtttcagcaactcctggaatccttcttcaacatcccaaccaacaattactcccagatagccatgtcacctgtgaattatcatgaatcccacatcaaataaacaaatactgcctctggactctaaattgcacatttttgagaaaatatttatgcaaagtgttccactgaaatgtatctcttacgaaagtatctgaatagtgaagtatttatcactcatcacagtaacttacggtaagaaatcaataaaattgttttattaaatgtacacataaaaaggcatataagtttttgaccttcagttgttttggaattaaattacatttcggcacccaaatatcttttaactgacagttttcacactttgcaaaacacacagggcactggaaactctaatgaaccagcatttacataatggtatctgccatatgaccactttggtaagcagcttgttgagattatgtactaagtgctttatgtgatgccaaaaaactttaaaaagcaaataataaatcatgaggctctacaaaatagcttagaaaaacaagttttctatttatttaaaaataagtttgtagttactacattgcagggacaggtattcttacacatacattctagtttgtataaaaggattcaaagaattatgcatcaaaactaacatagaaagtgtccacgtaacagtaaagaaaggtccaatcagtatgtacaaaaagaaagggcactgctattctggtgtgaaactgctgtttataatatgatactccaggttcggaaggaaaaaaacaaacttcaataaagctaaataattaatttgttttaaaactctgtgttacttattacatacaacagatctgcttgtgtttaaacattgttttctgtacaaaataagcataatcttaatttgaaaatgtgtcagtttcaactttcaccctctaggtcagttactttttaaaaattgagctacattctacacatgtctaaatatcctgtgacaggatttaagttttctaaaagatcttcagtaagacccctgtcttcttgcagttttaatatggtccaaaaatgtaactttgtattgtctcatgttatagtctatcattgtgactaatcaacacacacaatcttaaagtaaccagcatgtgtgcatctgccttatatgcatgtactatattccatcttgaacctattttcttggctccttgaattgtagaaactcagccatgcactaagtatttggtctgtgccataaggttaatttcctgataatttttatctgcattaaaaaagtatttcaacacagagctatcaaaactaaaaataatatctatttatagctcatattttctactcactgttctactgcagtgtgtacaaggtttatctctggagcgccaaaagtggtacttacagtcttctgactcaatttgaccttttcttgggtactatacatagttcgtaatgacttttcatttggagcaaactttgctcagtataattaacaaaaatagtttcttagtaagtgtaatattaattttagttcagatcacttggaaattaggggaactaagggaaactgcaagggtagaagcaaagaaaagtgtatttttcaaattttaatgggaaaataaattcttgcctaagtgtaacaaaaccactgctcaatctgttatgttagaaatactttttaggttaataggagtaatcagatgataaaactacttcccctattatgacttttaaaatcatgtaactcctgcatataagcagaacacttacagtcctttaatcactcaagtatcttggtcctttcaacctactcaaaaataaatttcaggtaacaaaaacattcagaatatatccgttttcattagatagaaaactgaaaaagttgcttctagctgacatttgagagagatatacagtaggtatatatgtataaaatggaatgtcagaattgaagtaaacattgttaactggagaaattaatttatattacaaatcatatctgaaaacatgtaaatgctgctaacatataagataaaaatatttgaatacatttcttaaaatgtctgattcctctactgcactgcagatgagggacagttctagatgttaacatacatgctgcataaagatattttctctgattactgtatcttatgtaattcatttccaagtgataactaaatttagtcaatcccaagtctcagatgttacctaatccagctcacaaatattccacatacttatttacttggattggaggaagacagttttataataatgccagcagtctttaaatttgtagtgaagttgtgcaataaaaacaattgaaataaggccaatctttagtttataatacatgcagaaaatagtccaatgccactatagcaggtcacaaaggataaaattttaaaaagctatgtatctattgcccagggctgtgagtctctgattagactaaatatttaaactaatgct

SEQ ID NO: 280527 - DNA, 3014 bp, Homo sapiens
agcggatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgcaactcctggaatccttcttcaacatcccaaccaacaattactcccagatagccatgtcacctgtgaattatcatgaatcccacatcaaataaacaaatactgcctctggactctaaattgcacatttttgagaaaatatttatgcaaagtgttccactgaaatgtatctcttacgaaagtatctgaatagtgaagtatttatcactcatcacagtaacttacggtaagaaatcaataaaattgttttattaaatgtacacataaaaaggcatataagtttttgaccttcagttgttttggaattaaattacatttcggcacccaaatatcttttaactgacagttttcacactttgcaaaacacacagggcactggaaactctaatgaaccagcatttacataatggtatctgccatatgaccactttggtaagcagcttgttgagattatgtactaagtgctttatgtgatgccaaaaaactttaaaaagcaaataataaatcatgaggctctacaaaatagcttagaaaaacaagttttctatttatttaaaaataagtttgtagttactacattgcagggacaggtattcttacacatacattctagtttgtataaaaggattcaaagaattatgcatcaaaactaacatagaaagtgtccacgtaacagtaaagaaaggtccaatcagtatgtacaaaaagaaagggcactgctattctggtgtgaaactgctgtttataatatgatactccaggttcggaaggaaaaaaacaaacttcaataaagctaaataattaatttgttttaaaactctgtgttacttattacatacaacagatctgcttgtgtttaaacattgttttctgtacaaaataagcataatcttaatttgaaaatgtgtcagtttcaactttcaccctctaggtcagttactttttaaaaattgagctacattctacacatgtctaaatatcctgtgacaggatttaagttttctaaaagatcttcagtaagacccctgtcttcttgcagttttaatatggtccaaaaatgtaactttgtattgtctcatgttatagtctatcattgtgactaatcaacacacacaatcttaaagtaaccagcatgtgtgcatctgccttatatgcatgtactatattccatcttgaacctattttcttggctccttgaattgtagaaactcagccatgcactaagtatttggtctgtgccataaggttaatttcctgataatttttatctgcattaaaaaagtatttcaacacagagctatcaaaactaaaaataatatctatttatagctcatattttctactcactgttctactgcagtgtgtacaaggtttatctctggagcgccaaaagtggtacttacagtcttctgactcaatttgaccttttcttgggtactatacatagttcgtaatgacttttcatttggagcaaactttgctcagtataattaacaaaaatagtttcttagtaagtgtaatattaattttagttcagatcacttggaaattaggggaactaagggaaactgcaagggtagaagcaaagaaaagtgtatttttcaaattttaatgggaaaataaattcttgcctaagtgtaacaaaaccactgctcaatctgttatgttagaaatactttttaggttaataggagtaatcagatgataaaactacttcccctattatgacttttaaaatcatgtaactcctgcatataagcagaacacttacagtcctttaatcactcaagtatcttggtcctttcaacctactcaaaaataaatttcaggtaacaaaaacattcagaatatatccgttttcattagatagaaaactgaaaaagttgcttctagctgacatttgagagagatatacagtaggtatatatgtataaaatggaatgtcagaattgaagtaaacattgttaactggagaaattaatttatattacaaatcatatctgaaaacatgtaaatgctgctaacatataagataaaaatatttgaatacatttcttaaaatgtctgattcctctactgcactgcagatgagggacagttctagatgttaacatacatgctgcataaagatattttctctgattactgtatcttatgtaattcatttccaagtgataactaaatttagtcaatcccaagtctcagatgttacctaatccagctcacaaatattccacatacttatttacttggattggaggaagacagttttataataatgccagcagtctttaaatttgtagtgaagttgtgcaataaaaacaattgaaataaggccaatctttagtttataatacatgcagaaaatagtccaatgccactatagcaggtcacaaaggataaaattttaaaaagctatgtatctattgcccagggctgtgagtctctgattagactaaatatttaaactaatgct

SEQ ID NO: 280528 - DNA, 3553 bp, Homo sapiens
agcggatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgacggcaagcctgtcttgttgctgttgagaatgcgtggcgcaaagctcaagaagtctgtaaccttgttggccaaaccttaggaaaacctttactaatcaaagaagaagaaacaaaagaatgggaaggccaaatagatgatcaccagtcatccagactctcaagttcattaactgtacaacaaaaaatcaaaagtgcaacaatacatgctgcttcaaaagtatttataacttttgagaagttactcaggcgtggtggcgtgtgactgtaatctcagctaccggggaggctgaagcagaagaaacgctcgaacctgggaggcagagcttacagtgagccgagatcgcaccactgcacttcagcctgggtgacaaagtgagactccatctacatacatacatacatacatacatacatacatacataaaatgcccagtatcttacaagactgtagttcacagtgggtaattcaaatcagacactgctcttcaagagaggtaatattaatagaaatctttcaagaaggattgttttctactattaaaacaataaaactcttataaacctgtttatcagaaggatatttctgtttcagcaactcctggaatccttcttcaacatcccaaccaacaattactcccagatagccatgtcacctgtgaattatcatgaatcccacatcaaataaacaaatactgcctctggactctaaattgcacatttttgagaaaatatttatgcaaagtgttccactgaaatgtatctcttacgaaagtatctgaatagtgaagtatttatcactcatcacagtaacttacggtaagaaatcaataaaattgttttattaaatgtacacataaaaaggcatataagtttttgaccttcagttgttttggaattaaattacatttcggcacccaaatatcttttaactgacagttttcacactttgcaaaacacacagggcactggaaactctaatgaaccagcatttacataatggtatctgccatatgaccactttggtaagcagcttgttgagattatgtactaagtgctttatgtgatgccaaaaaactttaaaaagcaaataataaatcatgaggctctacaaaatagcttagaaaaacaagttttctatttatttaaaaataagtttgtagttactacattgcagggacaggtattcttacacatacattctagtttgtataaaaggattcaaagaattatgcatcaaaactaacatagaaagtgtccacgtaacagtaaagaaaggtccaatcagtatgtacaaaaagaaagggcactgctattctggtgtgaaactgctgtttataatatgatactccaggttcggaaggaaaaaaacaaacttcaataaagctaaataattaatttgttttaaaactctgtgttacttattacatacaacagatctgcttgtgtttaaacattgttttctgtacaaaataagcataatcttaatttgaaaatgtgtcagtttcaactttcaccctctaggtcagttactttttaaaaattgagctacattctacacatgtctaaatatcctgtgacaggatttaagttttctaaaagatcttcagtaagacccctgtcttcttgcagttttaatatggtccaaaaatgtaactttgtattgtctcatgttatagtctatcattgtgactaatcaacacacacaatcttaaagtaaccagcattggctccttgaattgtagaaactcagccatgcactaagtatttggtctgtgccataaggttaatttcctgataatttttatctgcattaaaaaagtatttcaacacagagctatcaaaactaaaaataatatctatttatagctcatattttctactcactgttctactgcagtgtgtacaaggtttatctctggagcgccaaaagtggtacttacagtcttctgactcaatttgaccttttcttgggtactatacatagttcgtaatgacttttcatttggagcaaactttgctcagtataattaacaaaaatagtttcttagtaagtgtaatattaattttagttcagatcacttggaaattaggggaactaagggaaactgcaagggtagaagcaaagaaaagtgtatttttcaaattttaatgggaaaataaattcttgcctaagtgtaacaaaaccactgctcaatctgttatgttagaaatactttttaggttaataggagtaatcagatgataaaactacttcccctattatgacttttaaaatcatgtaactcctgcatataagcagaacacttacagtcctttaatcactcaagtatcttggtcctttcaacctactcaaaaataaatttcaggtaacaaaaacattcagaatatatccgttttcattagatagaaaactgaaaaagttgcttctagctgacatttgagagagatatacagtaggtatatatgtataaaatggaatgtcagaattgaagtaaacattgttaactggagaaattaatttatattacaaatcatatctgaaaacatgtaaatgctgctaacatataagataaaaatatttgaatacatttcttaaaatgtctgattcctctactgcactgcagatgagggacagttctagatgttaacatacatgctgcataaagatattttctctgattactgtatcttatgtaattcatttccaagtgataactaaatttagtcaatcccaagtctcagatgttacctaatccagctcacaaatattccacatacttatttacttggattggaggaagacagttttataataatgccagcagtctttaaatttgtagtgaagttgtgcaataaaaacaattgaaataaggccaatctttagtttataatacatgcagaaaatagtccaatgccactatagcaggtcacaaaggataaaattttaaaaagctatgtatctattgcccagggctgtgagtctctgattagactaaatatttaaactaatgct

SEQ ID NO: 280529 - DNA, 3553 bp, Homo sapiens
agcggatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgacggcaagcctgtcttgttgctgttgagaatgcgtggcgcaaagctcaagaagtctgtaaccttgttggccaaaccttaggaaaacctttactaatcaaagaagaagaaacaaaagaatgggaaggccaaatagatgatcaccagtcatccagactctcaagttcattaactgtacaacaaaaaatcaaaagtgcaacaatacatgctgcttcaaaagtatttataacttttgagaagttactcaggcgtggtggcgtgtgactgtaatctcagctaccggggaggctgaagcagaagaaacgctcgaacctgggaggcagagcttacagtgagccgagatcgcaccactgcacttcagcctgggtgacaaagtgagactccatctacatacatacatacatacatacatacatacatacataaaatgcccagtatcttacaagactgtagttcacagtgggtaattcaaatcagacactgctcttcaagagaggtaatattaatagaaatctttcaagaaggattgttttctactattaaaacaataaaactcttataaacctgtttatcagaaggatatttctgtttcagcaactcctggaatccttcttcaacatcccaaccaacaattactcccagatagccatgtcacctgtgaattatcatgaatcccacatcaaataaacaaatactgcctctggactctaaattgcacatttttgagaaaatatttatgcaaagtgttccactgaaatgtatctcttacgaaagtatctgaatagtgaagtatttatcactcatcacagtaacttacggtaagaaatcaataaaattgttttattaaatgtacacataaaaaggcatataagtttttgaccttcagttgttttggaattaaattacatttcggcacccaaatatcttttaactgacagttttcacactttgcaaaacacacagggcactggaaactctaatgaaccagcatttacataatggtatctgccatatgaccactttggtaagcagcttgttgagattatgtactaagtgctttatgtgatgccaaaaaactttaaaaagcaaataataaatcatgaggctctacaaaatagcttagaaaaacaagttttctatttatttaaaaataagtttgtagttactacattgcagggacaggtattcttacacatacattctagtttgtataaaaggattcaaagaattatgcatcaaaactaacatagaaagtgtccacgtaacagtaaagaaaggtccaatcagtatgtacaaaaagaaagggcactgctattctggtgtgaaactgctgtttataatatgatactccagaaactctgtgttacttattacatacaacagatctgcttgtgtttaaacattgttttctgtacaaaataagcataatcttaatttgaaaatgtgtcagtttcaactttcaccctctaggtcagttactttttaaaaattgagctacattctacacatgtctaaatatcctgtgacaggatttaagttttctaaaagatcttcagtaagacccctgtcttcttgcagttttaatatggtccaaaaatgtaactttgtattgtctcatgttatagtctatcattgtgactaatcaacacacacaatcttaaagtaaccagcatgtgtgcatctgccttatatgcatgtactatattccatcttgaacctattttcttggctccttgaattgtagaaactcagccatgcactaagtatttggtctgtgccataaggttaatttcctgataatttttatctgcattaaaaaagtatttcaacacagagctatcaaaactaaaaataatatctatttatagctcatattttctactcactgttctactgcagtgtgtacaaggtttatctctggagcgccaaaagtggtacttacagtcttctgactcaatttgaccttttcttgggtactatacatagttcgtaatgacttttcatttggagcaaactttgctcagtataattaacaaaaatagtttcttagtaagtgtaatattaattttagttcagatcacttggaaattaggggaactaagggaaactgcaagggtagaagcaaagaaaagtgtatttttcaaattttaatgggaaaataaattcttgcctaagtgtaacaaaaccactgctcaatctgttatgttagaaatactttttaggttaataggagtaatcagatgataaaactacttcccctattatgacttttaaaatcatgtaactcctgcatataagcagaacacttacagtcctttaatcactcaagtatcttggtcctttcaacctactcaaaaataaatttcaggtaacaaaaacattcagaatatatccgttttcattagatagaaaactgaaaaagttgcttctagctgacatttgagagagatatacagtaggtatatatgtataaaatggaatgtcagaattgaagtaaacattgttaactggagaaattaatttatattacaaatcatatctgaaaacatgtaaatgctgctaacatataagataaaaatatttgaatacatttcttaaaatgtctgattcctctactgcactgcagatgagggacagttctagatgttaacatacatgctgcataaagatattttctctgattactgtatcttatgtaattcatttccaagtgataactaaatttagtcaatcccaagtctcagatgttacctaatccagctcacaaatattccacatacttatttacttggattggaggaagacagttttataataatgccagcagtctttaaatttgtagtgaagttgtgcaataaaaacaattgaaataaggccaatctttagtttataatacatgcagaaaatagtccaatgccactatagcaggtcacaaaggataaaattttaaaaagctatgtatctattgcccagggctgtgagtctctgattagactaaatatttaaactaatgct

SEQ ID NO: 280530 - DNA, 1857 bp, Homo sapiens
agcggatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgacggcaagcctgtcttgttgctgttgagaatgcgtggcgcaaagctcaagaagtctgtaaccttgttggccaaaccttaggaaaacctttactaatcaaagaagaagaaacaaaagaatgggaaggccaaatagatgatcaccagtcatccagactctcaagttcattaactgtacaacaaaaaatcaaaagtgcaacaatacatgctgcttcaaaagtatttataacttttgagaagttactcaggcgtggtggcgtgtgactgtaatctcagctaccggggaggctgaagcagaagaaacgctcgaacctgggaggcagagcttacagtgagccgagatcgcaccactgcacttcagcctgggtgacaaagtgagactccatctacatacatacatacatacatacatacatacatacataaaatgcccagtatcttacaagactgtagttcacagtgggtaattcaaatcagacactgctcttcaagagaggtaatattaatagaaatctttcaagaaggattgttttctactattaaaacaataaaactcttataaacctgtttatcagaaggatatttctgtttcagcaactcctggaatccttcttcaacatcccaaccaacaattactcccagatagccatgtcacctgtgaattatcatgaatcccacatcaaataaacaaatactgcctctggactctaaattgcacatttttgagaaaatatttatgcaaagtgttccactgaaatgtatctcttacgaaagtatctgaatagtgaagtatttatcactcatcacagtaacttacggtaagaaatcaataaaattgttttattaaatgtacacataaaaaggcatataagtttttgaccttcagttgttttggaattaaattacatttcggcacccaaatatcttttaactgacagttttcacactttgcaaaacacacagggcactggaaactctaatgaaccagcatttacataatggtatctgccatatgaccactttggtaagcagcttgttgagattatgtactaagtgctttatgtgatgccaaaaaactttaaaaagcaaataataaatcatgaggctctacaaaatagcttagaaaaacaagttttctatttatttaaaaataagtttgtagttactacattgcagggacaggtattcttacacatacattctagttttgatgcataattctttgaatccttttatacaactagaatgtatgtgtaagaatacctgtcctgcaatgtatgtgtaagaatacctgttactacattgcggacgcgtgggtc

SEQ ID NO: 280531 - DNA, 1379 bp, Homo sapiens
ctaaataataaacacttgtgtgctgggattacaggcgtgagccaccaaccttggacataaaatgggttaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagct

SEQ ID NO: 280532 - DNA, 2287 bp, Homo sapiens
aatgctagtagagcagggatgagatcggccgagggggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacagttcatcattcccctgcatattcttttcctgctgctatccagagaaatcagcctcagcgccctgaaagcttccttttccgagcaggtgtcagggcagaaaccaacaaaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtc

SEQ ID NO: 280533 - DNA, 1322 bp, Homo sapiens
tttgagacagagtctcactctgtcgcctaggctggagtgcagtggtgtgatcttggctcactgcaacctccacctcctggattcaatgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaa

SEQ ID NO: 280534 - DNA, 5003 bp, Homo sapiens
  misc_feature (4157)..(4157): n is a, c, g, or t
  misc_feature (4164)..(4164): n is a, c, g, or t
  misc_feature (4172)..(4172): n is a, c, g, or t
  misc_feature (4205)..(4205): n is a, c, g, or t
aatgctagtagagcagggatgagatcggccgagggggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacagttctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaanaaaaaanaaaaaaanccaactagttgttttaacaaacatatataatcnttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacacc

SEQ ID NO: 280535 - DNA, 6128 bp, Homo sapiens
  misc_feature (4157)..(4157): n is a, c, g, or t
  misc_feature (4164)..(4164): n is a, c, g, or t
  misc_feature (4172)..(4172): n is a, c, g, or t
  misc_feature (4205)..(4205): n is a, c, g, or t
aatgctagtagagcagggatgagatcggccgagggggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacagttctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaanaaaaaanaaaaaaanccaactagttgttttaacaaacatatataatcnttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagataaaaaacaa

SEQ ID NO: 280536 - DNA, 3207 bp, Homo sapiens
aatgctagtagagcagggatgagatcggccgagggggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacagttcatcattcccctgcatattcttttcctgctgctatccagagaaatcagcctcagcgccctgaaagcttccttttccgagcaggtgtcagggcagaaaccaacaaaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagataaaaaacaa

SEQ ID NO: 280537 - DNA, 3442 bp, Homo sapiens
  misc_feature (2931)..(2931): n is a, c, g, or t
  misc_feature (2961)..(2962): n is a, c, g, or t
  misc_feature (3001)..(3001): n is a, c, g, or t
  misc_feature (3018)..(3018): n is a, c, g, or t
aatgctagtagagcagggatgagatcggccgagggggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacagttcatcattcccctgcatattcttttcctgctgctatccagagaaatcagcctcagcgccctgaaagcttccttttccgagcaggtgtcagggcagaaaccaacaaaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcngctcactgcaacctccgcctcccgggctcnngcgattctcctgcctcagcctcccgagtagctgggacancaggtgcccgccaccancctgaccaacatggagaaaccccgtctctactaaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagataaaaaacaa

SEQ ID NO: 280538 - DNA, 4237 bp, Homo sapiens
  misc_feature (2266)..(2266): n is a, c, g, or t
  misc_feature (2273)..(2273): n is a, c, g, or t
  misc_feature (2281)..(2281): n is a, c, g, or t
  misc_feature (2314)..(2314): n is a, c, g, or t
gttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacagttctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaanaaaaaanaaaaaaanccaactagttgttttaacaaacatatataatcnttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagataaaaaacaa

SEQ ID NO: 280539 - DNA, 2769 bp, Homo sapiens
aatgctagtagagcagggatgagatcggccgagggggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaactgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataactttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtgggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaa

SEQ ID NO: 280540 - DNA, 2697 bp, Homo sapiens
aatgctagtagagcagggatgagatcggccgagggggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcagctgccagtttctgtggctgaatttacagcacttacagcatcttcctggccgggcgcggtggctcacgcctgtaatcccagcactttgggaggccgaggcgggtggatcacctgaggtcaggagttcaagactagcctgaccaacatggagaaaccccgtctctactaaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagataaaaaacaa

SEQ ID NO: 280541 - DNA, 2158 bp, Homo sapiens
aatgctagtagagcagggatgagatcggccgagggggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaa

SEQ ID NO: 280542 - DNA, 1480 bp, Homo sapiens
ggctgtcctggactttgtcacacaaaaagcatcacaaagtccacaaaaacagcacccgctcctagatggcgtagatggtgagtgccccttcccatccagaaggtctcagcacactgatgatagtgccttgtgcatgagtgatgacagacctaatgctctattaagttcacctgcaacagaaacaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagataaaaaacaa

SEQ ID NO: 280543 - DNA, 1657 bp, Homo sapiens
  misc_feature (17)..(17): n is a, c, g, or t
  misc_feature (27)..(27): n is a, c, g, or t
cgctcataactccgaanctcccttganccaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagataaaaaacaa

SEQ ID NO: 280544 - DNA, 795 bp, Homo sapiens
ggccgcgcatgcgctgagctggcgggcccgagtgttgtcggctgggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagacttgtcgcgagaatcgcctttcagaaatctcctatagaagcatgccactgggtttcatcctaggtaaagctcatatgtatgtaccacgctcggagccgtgactagc

SEQ ID NO: 280545 - DNA, 5012 bp, Homo sapiens
  misc_feature (4166)..(4166): n is a, c, g, or t
  misc_feature (4173)..(4173): n is a, c, g, or t
  misc_feature (4181)..(4181): n is a, c, g, or t
  misc_feature (4214)..(4214): n is a, c, g, or t
ggccgcgcatgcgctgagctggcgggcccgagtgttgtcggctgggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacagttctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaanaaaaaanaaaaaaanccaactagttgttttaacaaacatatataatcnttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacacc

SEQ ID NO: 280546 - DNA, 6363 bp, Homo sapiens
  misc_feature (4157)..(4157): n is a, c, g, or t
  misc_feature (4164)..(4164): n is a, c, g, or t
  misc_feature (4172)..(4172): n is a, c, g, or t
  misc_feature (4205)..(4205): n is a, c, g, or t
  misc_feature (5852)..(5852): n is a, c, g, or t
  misc_feature (5882)..(5883): n is a, c, g, or t
  misc_feature (5922)..(5922): n is a, c, g, or t
  misc_feature (5939)..(5939): n is a, c, g, or t
aatgctagtagagcagggatgagatcggccgagggggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacagttctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaanaaaaaanaaaaaaanccaactagttgttttaacaaacatatataatcnttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcngctcactgcaacctccgcctcccgggctcnngcgattctcctgcctcagcctcccgagtagctgggacancaggtgcccgccaccancctgaccaacatggagaaaccccgtctctactaaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagataaaaaacaa

SEQ ID NO: 280547 - DNA, 4189 bp, Homo sapiens
  misc_feature (25)..(25): n is a, c, g, or t
  misc_feature (2218)..(2218): n is a, c, g, or t
  misc_feature (2225)..(2225): n is a, c, g, or t
  misc_feature (2233)..(2233): n is a, c, g, or t
  misc_feature (2266)..(2266): n is a, c, g, or t
cctcgtgtcgaatcggcacgaggtncggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacagttctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaanaaaaaanaaaaaaanccaactagttgttttaacaaacatatataatcnttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagataaaaaacaa

SEQ ID NO: 280548 - DNA, 2278 bp, Homo sapiens
aatgctagtagagcagggatgagatcggccgagggggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagct

SEQ ID NO: 280549 - DNA, 2321 bp, Homo sapiens
aatgctagtagagcagggatgagatcggccgagggggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggccacttaactccacctggagag

SEQ ID NO: 280550 - DNA, 983 bp, Homo sapiens
tgagagcttcagactagaaaagggaaaaagccccacttttgcttcgtcactagaaaccgggtcatctgagtcagccgagccaagtgacgttaggccgacccgggccccgggctagcagagcggaggcgctgccacgaaactcgtacctgcggctaagagcaggaaaaccctttcctgtatgccatctgttttctgtggggccctgagtgatgaggagaggaacaaggattcatggaagtgaggtcaaatttgtcaagatgtccacaatcccgagacactttggcctgaaatacaaagaggaatcgtatatgtttaaagagcttgagaaagttcggcaggaaactaaaaaggattttctccgattcaagcagaagttggcctccaagccggctgtagatgaaagcccagtccacagcctccatgcccccggcccggcccgccccgcgcgcgtttcctgcgccgcagcccggacgtcgagaagatacccttcgcttaaaggccctgcgatgtccgcggccgccctcctgcaggaggtgctcggaggcgcgccgcgtccctcgggcctgggtgaggcggcggctccaggcaagacccggtcgtttcgcccccgggacttttacttgcggagctccgcgttcctacggcaccaggccctgaaaaagcccccagtcatcgcctcggggttcggcacggccagacccgtggtcctgctgcctccgcccgagccacccgtgaagcgcagagcgcgcggggtcttggagagctcgcggcacgcggctcccaggcgggtcttccacttgggaagggagcgcgaacagagccaggaggtagctcctctcgcagggccctgcatggccaaagagaggaaggccagctccgtctccgcagaggacggctacatggaggccagcagcgggcggaggaaagtgaggatccgcagcaacttcgtgagcgagagcggggcccgcgaggcgcgggaagcg

SEQ ID NO: 280551 - DNA, 856 bp, Homo sapiens
agccagtcgagcccacccggcccctaggcacaggaaaggcctgttggacactcgccgagcggcggggccaagctcaccgccacctgaattggagcggaggcgccctcgatgccgggtcaaatttgtcaagatgtccacaatcccgagacactttggcctgaaatacaaagaggaatcgtatatgtttaaagagcttgagaaagttcggcaggaaactaaaaaggattttctccgattcaagcagaagttggcctccaagccggctgtagatgaaagcccagtccacagcctccatgcccccggcccggcccgccccgcgcgcgtttcctgcgccgcagcccggacgtcgagaagatacccttcgcttaaaggccctgcgatgtccgcggccgccctcctgcaggaggtgctcggaggcgcgccgcgtccctcgggcctgggtgaggcggcggctccaggcaagacccggtcgtttcgcccccgggacttttacttgcggagctccgcgttcctacggcaccaggccctgaaaaagcccccagtcatcgcctcggggttcggcacggccagacccgtggtcctgctgcctccgcccgagccacccgtgaagcgcagagcgcgcggggtcttggagagctcgcggcacgcggctcccaggcgggtcttccacttgggaagggagcgcgaacagagccaggaggtagctcctctcgcagggccctgcatggccaaagagaggaaggccagctccgtctccgcagaggacggctacatggaggccagcagcgggcggaggaaagtgaggatccgcagcaacttcgtgagcgagagcggggcccgcgaggcgcgggaagcg

SEQ ID NO: 280552 - DNA, 1186 bp, Homo sapiens
gcacagagggcacctgtacaccttcagaccagtctgcaacctcaggctgagtaacagtgaactcaggagctggagcagtccattcaccctgaaattcctccttggtcactgccttctcagcagcagcctgctcttctttttcaatctcttcagatctctgtagaagtacagatcaggcatgacctcccatgggtgttcacgggaaatggtgccacgcatgcgcagaacttcccgagccagcatccaccacatcaaacccactgagtgagctcccttgttgttgcatgggatggcaatgtccacatagcgcagaggagaatctgtgttacacagcgcaatgatgtactgttccatctggaagtcaagattggtgccacctaagtgggttcctgctgcaaggaacttaaggacatcctcctccttcatttgcaggacatcaagggctccggacattgtgaaagtttccctttaagttacgatgggaatccagaacaacgccgtatggacccctctgcagcaggagaccttatcaaaattctcctagattacatgacagcagccctgggaacagaaggcaagtttttacattctgaggtactgggagttggaatttcaacatatgaattttgggaggatgcaacaaaatactccccagtgcttagagggtcctgtgcttatcaagcatctgtttagaaagccctttcacatgcatgatctcatctgatccttagaacagaactgttaaacaggaagagatcaagccagaagtgtttgactcttcaacaataatctggtgcccaaacacgtggggccacagagaagactcaggaccctgaaggagttgcctaaaaccctagctaaggtactagcaggggcccagtgaaacctcaccaagttctagcttctcctctggtgaaactgattgtgaaaacagaaaaggagaatggctatgccctcaaactacctggaaccctgattcttctcaaacttggcctctaatatccaacgggacataacatctgggtctcgctatgttgtgcaagctggcctcaaactcctgacctcaagcgatcctctttcctcggcctctcaaagtactgagattacaagcgtgagcaactgcacccagccaactatatttctgatttactttttgttgggaaaaaatcactagtaagtggacctg

SEQ ID NO: 280553 - DNA, 419 bp, Homo sapiens
gttcttccaatgacctagggtttgggaatacaattttaaaagcccatggccactcttgtagctattactttcatgggatgacctaaacagagtttcagactatgacaatgatttcctctccttgtggcccatgtgctgttccttcacacttccacagacttccatgggatatatgagtcaatactaaggtgatagctctagttattccttccaaggacatctggaatccgattatctgatgagatattctattgctccattttacagcaggagaccttatcaaaattctcctagattacatgacagcagccctgggaacagaaggcaagtttcttaaattatttcattcttccccaaccaaaattcctatgtaggaacccattaacaagaactgtttctagaaaggacttgggcctcca

SEQ ID NO: 280554 - DNA, 987 bp, Homo sapiens
gcacagagggcacctgtacaccttcagaccagtctgcaacctcaggctgagtaacagtgaactcaggagctggagcagtccattcaccctgaaattcctccttggtcactgccttctcagcagcagcctgctcttctttttcaatctcttcagatctctgtagaagtacagatcaggcatgacctcccatgggtgttcacgggaaatggtgccacgcatgcgcagaacttcccgagccagcatccaccacatcaaacccactgagtgagctcccttgttgttgcatgggatggcaatgtccacatagcgcagaggagaatctgtgttacacagcgcaatggtaggtaggttaacataagatgcctccgtgagaggctggtggtcagccctggggtcagtaaccacaagaagccgtggctcccggaaggctgcctggatctggttagtgaaggttccaggagtgaagcggccagcaattggagtggctccagtggcagcagcaaacttcagcacagccctctggccagtattcctggaggatataacactgacatcagcagggttttcaatggcaacaattgcacgagctgccagcagaagcttctcccaggtcctcttgagatttatgatatagatgccatcacttttccttttatagatgtactgttccatctggaagtcaagattggtgccacctaagtgggttcctgctgcaaggaacttaaggacatcctcctccttcatttgcaggacatcaagggctccggacattgtgaaagtttccctttaagttacgatgggaatccagaacaacgccgtatggacccctctgcagcaggagaccttatcaaaattctcctagattacatgacagcagccctgggaacagaaggcaagtttcttaaattatttcattcttccccaaccaaaattcctatgtaggaacccattaacaagaactgtttctagaaaggacttgggcctcca

SEQ ID NO: 280555 - DNA, 725 bp, Homo sapiens
aggtccctctccggtgcccagccagacaggaagtacagatgcccatacctccagatccctgactccctccccagctctcgggtctgcaggatccctctggattgcagctgagaggagttccccagcaggcagggaccccacgagacaagacgcagctttggaaggcccccagctctgaggggtggcgctggcctcctcgatgctcctggcctctgctggcctcctcctgggcctcctctggtgctgttgctctcccagctggctggcctggcaacctggtgcccgtggcctctgcctccactgcagcacagcctgtaccacgtgctacccatgtcccagccaggtctccccagggggctgcagttgagtggcccagccttataggatcagggaggccatccctagaggggcttcgggcacatgggaatgatactaggctctggggtcagactctttgggttctaaccccctggctctctgtctgatgttggacaggccccctaaccctctgagactcagctgcccctctagaaaataggacaattcctgcctcacagggttgggggcctgggggcctcgctgatcccaagccagcttgcttcacccccagatctcacctgccctgctctgccccatccacaggctccactgagtgaagccctcatcaaagactcaggaggcccctggcggggatagcaccgtttattaagaaaaatcaagacaaa

SEQ ID NO: 280556 - DNA, 188 bp, Homo sapiens
aggtccctctccggtgcccagccagacaggaagtacagatgcccatacctccagatccctgactccctccccagctctcgggtctgcaggatccctctggattgcagctgagaggagttccccagcaggcagggaccccacgagacaagacgcagctttggaaggttacaccttgctcctactcttcc

SEQ ID NO: 280557 - DNA, 516 bp, Homo sapiens
tgagtcagggtctcactcttacccaggctggagtgccgtggcagtcacaaatcactgcagcctcaaattcccaggctcaagtgatcctcccgcctcagcctcttgagtagctgctactacaagctcatgccaccacacatagctaaatgttttaaatttattttttgtaaacacagggtctcaccatcttgcccagtctggtctcaaactcctgggctcaagggatcatcctgcctcagcctcccaaaatgctaggactacaggtgtgagccactgcatctggtgagaaactcttgtacatgatgtgaactgctttgtatttatcaaattacatgccaaaagataataatcaattacagataagaacatgatctctaagttttaaatcttaagacttttagcaatgttctcctgcttatgattcataaaacctgagaagctgaactcatccgatgatcacacgataggctgaaaagcactggaccagatcaggacacaagtgttctaatccccact

SEQ ID NO: 280558 - DNA, 590 bp, Homo sapiens
tccccagactgtaaccagatgctcctacttgagaccaaacagcaaatgggttaggctccaagccagaagagagctgggggtcccaccttctgtcctctccatggttttctacaaggagcatgtcccactttcaacattgtaaaaaatgtgcaagccttgtttctgtttctaaaagcagcctgactgctgaagcttaccttcagtcaagggaaagatttcactcatcttctggcgggccatcctcaccttgggtctcaccatcttgcccagtctggtctcaaactcctgggctcaagggatcatcctgcctcagcctcccaaaatgctaggactacaggtgtgagccactgcatctggtgagaaactcttgtacatgatgtgaactgctttgtatttatcaaattacatgccaaaagataataatcaattacagataagaacatgatctctaagttttaaatcttaagacttttagcaatgttctcctgcttatgattcataaaacctgagaagctgaactcatccgatgatcacacgataggctgaaaagcactggaccagatcaggacacaagtgttctaatccccact

SEQ ID NO: 280559 - DNA, 865 bp, Homo sapiens
tctttccctggctggtcgaactgcctctacagttgtcccatccagaagccacacacagcagcgggcctcaggaattgcattcctcgcagtgacaggagaggatgtaccggtaggtggcagtgagtcgcatgccccctgagcatcgcagccgcagtgccttcagcttggaagtctggggccggcagcagtgacaggaggaacggaagggttgcttgaggacagtgctgaacgacaccaaaggctcggagcgtgacgcctggctgcagtgcccctcgcacctggccaggagcaccatctggggaaagaaaaggaggtggttactctgtgggcatgccacaaccttagccagcacttgaacatctcctgatctcttccggatcagagcttctcagactggaatgtgcgtgtgaatcatctaggatcttgttaaaagagtctccagcaccttccacagcacctggacatgatatttcccccaggagtcaatggcaaaaggatgaagagagaagcagacattccagtcctggcccttcttctgcactgccagcaacttctcttcagagccatggccaggaggccgaagtgcatccaggcattcccatagcgctcccaccccaaggcctttgccggagatgttcgggtcactgtgatggtatgctcgttcctgccaacccggtcactccagccccgctctcggcagcccaaagggcagctaagccatgtggctgctcctctcttgtcattggaactcgaattaagattgaaaactccacaggcacatttccatctgtgggtgtcagctgcttggtacacagtcgtaagaaggcctcagccagttctcccgttacctgaaccaaatgtattt

SEQ ID NO: 280560 - DNA, 514 bp, Homo sapiens
tgcgaagtttaggatggagctgaagagactgggttccgtcctacggtgggatttctttccgtgctcgcgcgttcagccccaagtctcagggccactcgtctgggaagttgtagaatctgtatagccaacctacacaacctccaaggggcctttggacaggaccatcagctttttccttgccttcggacttgaattaaacatcatctcttccttggcgtcaagcctgctgccatcagactggaactaaaccatcagctctcatgggactccatcttgctgacttatcctgcagatcttgggatttaaccgcctccataatcacgaatcctccctccaggtcactgggagcttcaattccttagaagaaagaagcaactatcaccatactatgaagtagcacaagcccttcaccagatacagtcgcccaatcttggaccatccagccccaagaaccatgagctaaataaacctctttccttgataaattaaaaaaaaaaaggggaaaacagaagaa

SEQ ID NO: 280561 - DNA, 656 bp, Homo sapiens
tgcgaagtttaggatggagctgaagagactgggttccgtcctacggtgggatttctttccgtgctcgcgcgttcagccccaagtctcagggccactcgtctgggaagttgtagaatctgtatagccaacctacacaacctccaaggggcctttggacaggaccatcagctttttccttgccttcggacttgaattaaacatcatctcttccttggcgtcaagcctgctgccatcagactggaactaaaccatcagctctcatgggactccatcttgctgacttatcctgcagatcttgggatttaaccgcctccataatcacgaatcctccctccaggtcactgggagcttcaattccttagaagaaagaaagagatgactcctgcttcatagtccaggaaaatccccacacaccgtggaggctctttaaggcggaaggaggtctgcggggatgtgagagcttcatactcattcccacgactctgtcgcagaagccagtgtccattggcagaagcaactatcaccatactatgaagtagcacaagcccttcaccagatacagtcgcccaatcttggaccatccagccccaagaaccatgagctaaataaacctctttccttgataaattaaaaaaaaaaaggggaaaacagaagaa

SEQ ID NO: 280562 - DNA, 873 bp, Homo sapiens
aactcactctgtgggtgggggaggagcatggttccggtggcttcagaaatgagcaacaagctatcggagccactgattcctcaaagaccaagagctggagaaaaataatttattttcatttattccatatcgttctatccatccactcttctgtttgaccaacattttgaattgcctactatgtgtttaccagcaaacaaggaagaacctggcttttgtaatctataatcgtaccaaggctgaaaccttacttttaaacaaataccagaattttaaaattataactgaggcacagacttctgccaggcctgcagacagagctcaggataaagagccaagggtgtggcctgtctcgaggcccatagatgtgcgctctgcaggtggaatggccgtccggtgcttactttgactgtcctcgggtcccgagtcttctggtggttaactgaggaaactgctgccttatgatctagcagaggatgataattgctgttgcccaggacaaccacaccagttcacaagaaatccgtgaagagagagcatctctcaaggtgaaaacataaccatgaggcccctttccttggggtttacggagatgatgtttgtggagaggcatgacaggtcaggggttacgtgcaagaactctggaactcgactacctgaattgaatgcaagctcaggcattggttaggctggatgcccttgggcaagttatttagtatccacatgactcagtttccccatttgtaaaataggaatgataataacctctagagttattgtgaaattttaaaaagtgaatgtatgtaaatagctggcagtagtgcctggcagttagtaagtacttaataaatgttacccattattaccaaagat

SEQ ID NO: 280563 - DNA, 848 bp, Homo sapiens
cccacccagaggacaactggccaggaaatctgcctgtttcttgtctcaccctctagtccacactctgcctaacactacgccctacctcacattcctattgacatctgctgcagatcacacccttgtgatggacaaactgctcagtacagtcccacccacccagcctccttgtcctgggcacgaggtttttgcctccctgatttggagtatttggcccttactagagagctgccagatgagggacatttccttcacctggagaaggatggggaggagtcagcacttgacatctgccaccctaccccagaatcagtgccacccttcgccagcccacccaaacctggtctcgtatatcatcccgcagctccaccaggatctggttgaagaggaactcagaggctcctcccggctcacctgcatcctcaaatacgccttctgtccagtcctaatctccagcccatcgacctccgctggaggaatgggggccagtgctggaaggcctgcatgttggtcacccagtttgcagtccacgtagagatgtagggcagggctgggtctggagggacctcggagtcgcaggagaactgtgtgtgtgcgcccatcagccaggcccgcttgctgtaggttcacggcgtggactttgccatcctcccgctggtatcgcaccagtactgcccaggaggggagatcagtatgggcgctatcccccaccccctgcctcccagctgagccttggatcaactctgctagataccacatctctagggcccctatccctaattctactatgtggctctcaacaccttgtatttaataggtacacaataaatgtttttgaaattgcttta

SEQ ID NO: 280564 - DNA, 1186 bp, Homo sapiens
cccacccagaggacaactggccaggaaatctgcctgtttcttgtctcaccctctagtccacactctgcctaacactacgccctacctcacattcctattgacatctgctgcagatcacacccttgtgatggacaaactgctcagtacagtcccacccacccagcctccttgtcctgggcacgaggtttttgcctccctgatttggagtatttggcccttactagagagctgccagatgagggtggataacagcctcagttttcagatgaggaagctgaggctcagaaaagttaaataacctgctaaagagctagcaagaggcaaaccagtattccaaaccaagtccatgtgaacacctaatctgtgtagtgccctggggaggaggaaaggcagcaggaaatttgaagacctgaaggggcagactttgggtggaaccagacctatggtgggtctcctcagatacagcagaggacactggacaggcctcacagtggaagccgggcatggtgttgatgcagctggagcccgggaaacaggggtcagcgtgagcacactggggaccagatgagaaggcagagggacatttccttcacctggagaaggatggggaggagtcagcacttgacatctgccaccctaccccagaatcagtgccacccttcgccagcccacccaaacctggtctcgtatatcatcccgcagctccaccaggatctggttgaagaggaactcagaggctcctcccggctcacctgcatcctcaaatacgccttctgtccagtcctaatctccagcccatcgacctccgctggaggaatgggggccagtgctggaaggcctgcatgttggtcacccagtttgcagtccacgtagagatgtagggcagggctgggtctggagggacctcggagtcgcaggagaactgtgtgtgtgcgcccatcagccaggcccgcttgctgtaggttcacggcgtggactttgccatcctcccgctggtatcgcaccagtactgcccaggaggggagatcagtatgggcgctatcccccaccccctgcctcccagctgagccttggatcaactctgctagataccacatctctagggcccctatccctaattctactatgtggctctcaacaccttgtatttaataggtacacaataaatgtttttgaaattgcttta

SEQ ID NO: 280565 - DNA, 852 bp, Homo sapiens
gttgaactccctcactttccgcttcccagcattggcgggttccgggactggtggctgcggtagctcattggcctttggtctcttagacggtggagaataatcatcatcttgaaaaagaaaatggtcattactggaagaaccatcttacagttacagtcacctcctggtcaattcccaacattcaaaagctaaagaaacaggctcagaggatgttatttgattggactatgttgtatctctggagagcacagctgagatcagactgtgtgtgtgtaactccactagactacgagggtgcttctcataaagggttgcaagatcatagttctcggggtgtttaaaggcaacaccttccggaagcccctgcactaccacagccgactggtctcgcagcatcttctcatatggtacaggtaccactgtggatttgcctaaagctttccctggggcagatgaaaagcggatgaacatcattcaatgtgcaggcctacccaactatggaatgatggaacagaaggcctcaccatggactcgagagctgacatgaggaatgtcaccaccatcctgctctccgaggactcctcatcttcaacggggagggtggacattgcaacttgggccatgatccctgtgcaggagaagtaagaagaaagtgagtggtagaaatctggtgtcctgaacccacagccaaagctgtgagggcccctcaccggctgcctaatttacagttttcttgctctagagacaaaataaggctcagaaactaagtatttgacttgcccaaaccctcataagataaagaatctatcccctaattttctatatattgttatttccagaaaattgggtcaa

SEQ ID NO: 280566 - DNA, 1602 bp, Homo sapiens
  misc_feature (1)..(2): n is a, c, g, or t
  misc_feature (4)..(4): n is a, c, g, or t
  misc_feature (6)..(7): n is a, c, g, or t
nncncnncctctctctctctccctctctctctccctctctctctctccctgtgtcgcttaaacaacagtcctaacttttgtgtgttgcaaatataaaaggcaagccatgtgacagagggacagaagaacaaaagcatttggaagtaacaggacctctttctagctctcagaaaagtctgagaagaaaggagccctgcgttcccctaagctgtgcagcagatactgtgatgatggattgcaagtgcaaagagtaagacaaaactccagcacataaaggacaatgacaaccagaaagcttcagcccgatcctgccctttccttgaacgggactggatcctaggagatggtgctcctggccaggtgcgaggggcactgcagccaggcgtcacgctccgagcctttggtgtcgttcagcactgtcctcaagcaacccttccgttcctcctgtcactgctgccggccccagacttccaagctgaaggcactgcggctgcgatgctcagggggcatgcgactcactgccacctaccggtacatcctctcctgtcactgcgaggaatgcaattcctgaggcccgctgctgtgtgtggcttctggatgggacaactgtagaggcagttcgaccagccagggaaagactggcaagaaaagagttaaggcaaaaaaggatgcaacaattctcccgggactctgcatattctagtaataaagactctacatgcttgttgacagagagagatactctgggaacttctttgcagttcccatctcctttctctggtacaatttcttttggttcattttcagattcaggcattttcccccttggctctcaatgctgtttgggtttccaacaattcagcattagtgggaaaaagtgggccctcatacacaagcgtgtcaggctgtcagtgtttggtgcacgctggggaagaatttactttggaaagtagaaaagcccagcttttcctgggacatcttctgttattgttgatgtttttttttaccttgtcattttggtctaaggttgccattgctgctaaaggttaccgatttcaaagtccagataccaagcatgtggatatgtttagctacgtttactcacagccagcgaactgacattaaaataactaacaaacagattcttttatgtgatgctggaactcttgacagctataattattattcagaaatgactttttgaaagtaaaagcagcataaagaatttgtcacaggaaggctgtctcagataaattatggtaaaattttgtaagggagcagacttttaaagacttgcacaaatacggatcctgcactgactctggaaaaggcatatatgtactagtggcatggagaatgcaccatactcatgcatgcaaattagacaaccaagtatgaatctatttgtgggtgtgctatagctttagccgtgtcacgggcatcattctctaatatccacttgtccatgtgaaacatgttgccaaaatggtggcctggcttgtcttctgaacgtttggttcaaatgtgttttggtcctggaggctcaaattttgagttattcccacgttttgaaataaaaagagtatattcaaaatttaaaaa

SEQ ID NO: 280567 - DNA, 1671 bp, Homo sapiens
  misc_feature (1)..(2): n is a, c, g, or t
  misc_feature (4)..(4): n is a, c, g, or t
  misc_feature (6)..(7): n is a, c, g, or t
nncncnncctctctctctctccctctctctctccctctctctctctccctgtgtcgcttaaacaacagtcctaacttttgtgtgttgcaaatataaaaggcaagccatgtgacagagggacagaagaacaaaagcatttggaagtaacaggacctctttctagctctcagaaaagtctgagaagaaaggagccctgcgttcccctaagctgtgcagcagatactgtgatgatggattgcaagtgcaaagagtaagacaaaactccagcacataaaggacaatgacaaccagaaagcttcagcccgatcctgccctttccttgaacgggactggatcctaggaggtgaagccatttccaattttttgtcctctgcctccctctgctgttcttctagagaagtttttccttacaacaatgagaaaacatgtactagctgcatccttttctatgctctccctgctggtgataatgggagatacagacagtaaaacggacagctcattcataatggactcggaccctcgacgctgcatgaggcaccactatgtggattctatcagtcacccattgtacaagtgtagctcaaagatggtgctcctggccaggtgcgaggggcactgcagccaggcgtcacgctccgagcctttggtgtcgttcagcactgtcctcaagcaacccttccgttcctcctgtcactgctgccggccccagacttccaagctgaaggcactgcggctgcgatgctcagggggcatgcgactcactgccacctaccggtacatcctctcctgtcactgcgaggaatgcaattcctgaggcccgctgctgtgtgtggcttctggatgggacaactgtagaggcagttcgaccagccagggaaagactggcaagaaaagagttaaggcaaaaaaggatgcaacaattctcccgggactctgcatattctagtaataaagactctacatgcttgttgacagagagagatactctgggaacttctttgcagttcccatctcctttctctggtacaatttcttttggttcattttcagattcaggcattttcccccttggctctcaatgctgtttgggtttccaacaattcagcattagtgggaaaaagtgggccctcatacacaagcgtgtcaggctgtcagtgtttggtgcacgctggggaagaatttactttggaaagtagaaaagcccagcttttcctgggacatcttctgttattgttgatgtttttttttaccttgtcattttggtctaaggttgccattgctgctaaaggttaccgatttcaaagtccagataccaagcatgtggatatgtttagctacgtttactcacagccagcgaactgacattaaaataactaacaaacagattcttttatgtgatgctggaactcttgacagctataattattattcagaaatgactttttgaaagtaaaagcagcataaagaatttgtcacaggaaggctgtctcagataaattatggtaaaattttgtaagggagcagacttttaaagacttgcatgttgccaaaatggtggcctggcttgtcttctgaacgtttggttcaaatgtgttttggtcctggaggctcaaattttgagttattcccacgttttgaaataaaaagagtatattcaaaatttaaaaa

SEQ ID NO: 280568 - DNA, 1848 bp, Homo sapiens
  misc_feature (1)..(2): n is a, c, g, or t
  misc_feature (4)..(4): n is a, c, g, or t
  misc_feature (6)..(7): n is a, c, g, or t
nncncnncctctctctctctccctctctctctccctctctctctctccctgtgtcgcttaaacaacagtcctaacttttgtgtgttgcaaatataaaaggcaagccatgtgacagagggacagaagaacaaaagcatttggaagtaacaggacctctttctagctctcagaaaagtctgagaagaaaggagccctgcgttcccctaagctgtgcagcagatactgtgatgatggattgcaagtgcaaagagtaagacaaaactccagcacataaaggacaatgacaaccagaaagcttcagcccgatcctgccctttccttgaacgggactggatcctaggaggtgaagccatttccaattttttgtcctctgcctccctctgctgttcttctagagaagtttttccttacaacaatgagaaaacatgtactagctgcatccttttctatgctctccctgctggtgataatgggagatacagacagtaaaacggacagctcattcataatggactcggaccctcgacgctgcatgaggcaccactatgtggattctatcagtcacccattgtacaagtgtagctcaaagatggtgctcctggccaggtgcgaggggcactgcagccaggcgtcacgctccgagcctttggtgtcgttcagcactgtcctcaagcaacccttccgttcctcctgtcactgctgccggccccagacttccaagctgaaggcactgcggctgcgatgctcagggggcatgcgactcactgccacctaccggtacatcctctcctgtcactgcgaggaatgcaattcctgaggcccgctgctgtgtgtggcttctggatgggacaactgtagaggcagttcgaccagccagggaaagactggcaagaaaagagttaaggcaaaaaaggatgcaacaattctcccgggactctgcatattctagtaataaagactctacatgcttgttgacagagagagatactctgggaacttctttgcagttcccatctcctttctctggtacaatttcttttggttcattttcagattcaggcattttcccccttggctctcaatgctgtttgggtttccaacaattcagcattagtgggaaaaagtgggccctcatacacaagcgtgtcaggctgtcagtgtttggtgcacgctggggaagaatttactttggaaagtagaaaagcccagcttttcctgggacatcttctgttattgttgatgtttttttttaccttgtcattttggtctaaggttgccattgctgctaaaggttaccgatttcaaagtccagataccaagcatgtggatatgtttagctacgtttactcacagccagcgaactgacattaaaataactaacaaacagattcttttatgtgatgctggaactcttgacagctataattattattcagaaatgactttttgaaagtaaaagcagcataaagaatttgtcacaggaaggctgtctcagataaattatggtaaaattttgtaagggagcagacttttaaagacttgcacaaatacggatcctgcactgactctggaaaaggcatatatgtactagtggcatggagaatgcaccatactcatgcatgcaaattagacaaccaagtatgaatctatttgtgggtgtgctatagctttagccgtgtcacgggcatcattctctaatatccacttgtccatgtgaaacatgttgccaaaatggtggcctggcttgtcttctgaacgtttggttcaaatgtgttttggtcctggaggctcaaattttgagttattcccacgttttgaaataaaaagagtatattcaaaatttaaaaa

SEQ ID NO: 280569 - DNA, 787 bp, Homo sapiens
agcgggggctggcgcttccggcaccggccgaggtgcgggtcgcctccagagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggtttactaaa

SEQ ID NO: 280570 - DNA, 873 bp, Homo sapiens
agcgggggctggcgcttccggcaccggccgaggtgcgggtcgcctccagaggtgcgtggtcgtggcgcgagggatcctgaggctgctccagcagtgcgccgccgccgtctcctggggcggcttgggttagccgggagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggtttactaaa

SEQ ID NO: 280571 - DNA, 949 bp, Homo sapiens
agcgggggctggcgcttccggcaccggccgaggtgcgggtcgcctccagagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggtttactaaaaaaaaacgcaacaccaaaacacagaagcaaaaaaaccaaacggaaccgaccacacaaaaaaaggggcgggggaaagagcaacaatcactgcgcgcaggagcgagaccacaaggagacgagcagacagaatgtgggaacaaagagcgagcaacacaaagcggg

SEQ ID NO: 280572 - DNA, 805 bp, Homo sapiens
agcgggggctggcgcttccggcaccggccgaggtgcgggtcgcctccagagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcaggtggcttttgttttacagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggtttactaaa

SEQ ID NO: 280573 - DNA, 691 bp, Homo sapiens
agcgggggctggcgcttccggcaccggccgaggtgcgggtcgcctccagaggtgcgtggtcgtggcgcgagggatcctgaggctgctccagcagtgcgccgccgccgtctcctggggcggcttgggttagccgggagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcaggggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggtttactaaa

SEQ ID NO: 280574 - DNA, 819 bp, Homo sapiens
agcgggggctggcgcttccggcaccggccgaggtgcgggtcgcctccagagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggtttactaaatactacaaaacaacaagaaaactctccagcac

SEQ ID NO: 280575 - DNA, 949 bp, Homo sapiens
agcgggggctggcgcttccggcaccggccgaggtgcgggtcgcctccagagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtctgatcatctaaatcacccgaaaatttcagcaagcatccaatcttttcttctagagatttctataaaaatatacaaagtgatcaaaaagtttcttaaaagcaacaacagaccagaaatgactcacaccaccttatagctatacaagaaaaagactagaaaccaaaatgctattttaaagtagtttcttccgccggggcagcaagagcgaaactccatctcaaaaaataataataataataaataaataaagtagtttcatag

SEQ ID NO: 280576 - DNA, 735 bp, Homo sapiens
agcgggggctggcgcttccggcaccggccgaggtgcgggtcgcctccagagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaaaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggtttactaaa

SEQ ID NO: 280577 - DNA, 1014 bp, Homo sapiens
agcgggggctggcgcttccggcaccggccgaggtgcgggtcgcctccagaggtgcgtggtcgtggcgcgagggatcctgaggctgctccagcagtgcgccgccgccgtctcctggggcggcttgggttagccgggaggtgggtcagaggctcgccccgtgccctgcgtccgggcgtctccttagggcgcgtcttcgggtccggccagcggtgctgaaaaagggagaaggttgggggtagggaggaaacaagatcccagttcaatagatttctccgcagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggtttactaaa

SEQ ID NO: 280578 - DNA, 213 bp, Homo sapiens
ctcgttttgaacacgtagttctgtgtccggaactggtgggttcttggtctcactgacttcaagaatgaagctgcggaccctcgcggcaaagttggacatcccaaagatggcatagataaacatgaccaggaagagcaggaggccgatgttaaacaacgcaggaagggacatcatcaaagcaaagagcagcgtgcggatcccctttgctccttt

SEQ ID NO: 280579 - DNA, 765 bp, Homo sapiens
cgcctctggctcgtgagtgccccaagttcagctgcacgcttggagtagatggagccttctgtctggtttagcaccaacccgaggggttcccgcccctcagactgcgccttagaccgttgtggggaaggcggggagggactcaggctccgcccgtctcggctccgccccggcctcactgcaggcgcagccctatacccgcacctggtcgctgcaccagtaccagcccgagacgattgtgagtccgaggagcagcgcgggccacggcagatccccggtcacggggtgccggagcaggtggtaggagtcgggccggggtcgatagcagaagctggagatgtttcccacggctggatcctcggacaccgtcagcgaagtcgctgctcccaggtatttgtcgaagagacccgaatacccgcccacctcgtggaaggctgccgggcaaggccgtcaggggaccctccttaggaccctcagaccggagacgcgcaacggccccgcgcgcaggccgagagctccgcgaccatgccctccgcgcccctccctggtaggcgagcccctaccgtaacccatgaggatgcaggcgccccccagaatgacgaaggtctgtaccgtgtccgtgtacatcagcgcggccagccctcctgcaacaggccggggtcaggggacagcccagctgtttatgttacaggctggccttagcaataaggcgtctttgtgggaatttgaaagagttccccttcctggagaataaatttcaaaacgata

SEQ ID NO: 280580 - DNA, 493 bp, Homo sapiens
cagggcggctgcagctgcgcgagggacgacccctcccagcagcgggctccgcagcgagcttgcgcctgtggcccggggctgcccttaccgttgggcatgagcttcacgacgagccgcgggcgcagccctatacccgcacctggtcgctgcaccagtaccagcccgagacgattgtgagtccgaggagcagcgcgggccacggcagatccccggtcacggggtgccggagcaggccgagagctccgcgaccatgccctccgcgcccctccctggtaggcgagcccctaccgtaacccatgaggatgcaggcgccccccagaatgacgaaggtctgtaccgtgtccgtgtacatcagcgcggccagccctcctgcaacaggccggggtcaggggacagcccagctgtttatgttacaggctggccttagcaataaggcgtctttgtgggaatttgaaagagttccccttcctggagaataaatttcaaaacgata

SEQ ID NO: 280581 - DNA, 392 bp, Homo sapiens
acaaaaaaaaaaagttatgtcataaagatataaaccggtgctgtgactcacctgctcttagccgcaggtgcgagcgtctttgtgcggcggacaaatggggagaggacgaggaggtgggcactcaagcgacgtaagatccacatcagctcaactgcacttgcctcgcagaggcagcccgctcacttcccgcggaggcgctccccggcgccgcgctccgcggcagccgcctgcccccggcgctgcccccgcccgccgcgccgccgccgccgccgcgcacgccgcgccccgcagctctgggcttcctcttcgcccgggtggcgttgggcccgcgcgggcgctcgggtgactgcagctgctcagctcccctcccccgccccgcgccgcgcggccgc

SEQ ID NO: 280582 - DNA, 3275 bp, Homo sapiens
cggggctgtctccagggaaacgcgacgctctccgtaggcgcagggctggcaagcagtcgggacgggagcgcgggcgtccgcggtggctgcagtcccgtcggtctccctgctgtccggcgcgagctcttcgagtcttgcttgggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccaggggctatacaaagcggaccagcggtttgggccaggtgtcgagacctaccccgatggcagccaggacgtggggctgtggttccgagagcagctcatcaagctgtgcacccagatccccagtggcttctccctcctcagataccctgagttctccagcttcatcacccacagccctgccaggatcagcctctcagaagaggagaaaacggagtggggactgcaggagggacaggatccctttttctatgactataagcggtttcttctgaatgacaacctaacgctgcctccagaaatgtatgtctactcgaccaacagtgaccacctgcccatgacaagctctttccgcaaagagctggacgcccgcatcttcctcaatgaaattcctccgttcgttgaggatggagaaccatggttcataatcaatgagacccctttgttggtcaaaatccagaagcaaacttacaagttcaggaacaagccagctcacaccagctggaacatgggcgccatcctggaggggaagcgcagtggctttgcaccctgtgggcccaaagagcaactttccatggagatgatcctaaaggctgaggaagggaaccacgaatggatttgtaggatcctgaaggacaactttgctagtgctgacgtggcggacgcaaagggctacactgtgcttgctgcggctgctactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggaacctccaaaattcccagttgttccaatcctttcatcatcatttatggacacaaacctggagtctctgtactatgaggtgaacgtgccttcccagggtagctatgagctgaggccaccgccagcaccactgctcctgccacgcgtctcaggcagccacgagggcggccacttccaggacaccgggcagtgtggggggtccatagaccacaggagcagctctctgaagggggactccccgttggtgaagggcagccttggccatgtggaaagcgggcttgaggacgtgttgggaaacacagaccggggcagtctgtgcagtgctgagacgaaatttgagtccaacgtgtgtgtgtgcgacttctccatcgagctctcgcaggccatgctggagagaagcgcccagtcccacagcttgctgaagatggcctcgccctcaccgtgcaccagcagcttcgacaaagggaccatgcggaggatggcgctgtccatgatcgagcggaggaagcgctggcggaccatcaagctgctgctgcgccggggcgcggaccccaacctgtgctgcgtgcccatgcaggtcctgttccttgctgtgaaggccggggacgtggatggggtgaggctgctgctggagcacggggcgaggaccgacatctgctttccgccgcagctgagcaccctgacaccactccacatcgctgccgcccttcctggggaggagggggtacagattgtggagctgctgttgcatgccatcaccgatgtggacgccaaggcatccgacgaggacgacacttacaagcccggcaagctggacctgctgccctcaagtctgaagctcagcaatgagccaggccctccccaagcctactacagcacggacacagccctcccggaggaggggggcaggacggctctgcacatggcctgcgagcgggaggatgacaacaagtgtgccagggacatagtccggctccttctatcccacggagcaaatcctaacctgctgtggagtggccactccccgctctccctgtccattgccagtgggaatgagctggttgtgaaggagctcctgacccagggagctgaccccaacctgcccctgaccaaaggcttgggcagtgccctgtgtgttgcctgtgacctgacctacgagcaccagaggaacatggacagcaagctggccctgattgaccgactcatcagtcacggggccgacatcctgaagcctgtaatgctcaggcagggagaaaaggaggcagtgggcacagccgtggactatggctacttcagattcttccaggaccggaggattgcccgctgccccttccacacgctgatgccagcagagcgcgagacgttcctggcgcggaagcggctcctggagtacatgggcttgcagctacggcaggctgtctttgccaaggagagccagtgggaccccacgtggctgtacctgtgcaagagagcggagctgatccccagccacaggatgaagaagaagggccccagcctgcccaggggcctggatgtgaaggagcaggggcaaattcccttcttcaagttctgctaccagtgtggccgctccatcggggtccgcctcttgccctgccctcgctgctacgggatcctgacctgcagcaagtactgcaagaccaaggcctggaccgagttccacaagaaggactgcggggacctggtggccatcgtgacacaactggagcaagtttccaggaggagagaagaattccagtgaagcagcagctgcacgtccgaggcttggggaggacccaggactgtgtgggtttcttacctgcctgagccacctcagggaatcttccagcctaatgcaggcatttctgcacctttggggtcatgctttgtagcagtgtctcccttgcgacctcgcaataaattggccccacggggtgattttgacagtc

SEQ ID NO: 280583 - DNA, 2499 bp, Homo sapiens
cggggctgtctccagggaaacgcgacgctctccgtaggcgcagggctggcaagcagtcgggacgggagcgcgggcgtccgcggtggctgcagtcccgtcggtctccctgctgtccggcgcgagctcttcgagtcttgcttggttggaagaccacagacatggaaggggcccatgcctcccttagcttagaggacgaagtctctggggctggcagccgccaacgcccgctagaggggaagggcggcgagacccctgctgccgaggagccggggtccctgaagaactacgctgtcttcgccacaagggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccagactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggaacctccaaaattcccagttgttccaatcctttcatcatcatttatggacacaaacctggagtctctgtactatgaggtgaacgtgccttcccagggtagctatgagctgaggccaccgccagcaccactgctcctgccacgcgtctcaggcagccacgagggcggccacttccaggacaccgggcagtgtggggggtccatagaccacaggagcagctctctgaagggggactccccgttggtgaagggcagccttggccatgtggaaagcgggcttgaggacgtgttgggaaacacagaccggggcagtctgtgcagtgctgagacgaaatttgagtccaacgtgtgtgtgtgcgacttctccatcgagctctcgcaggccatgctggagagaagcgcccagtcccacagcttgctgaagatggcctcgccctcaccgtgcaccagcagcttcgacaaagggaccatgcggaggatggcgctgtccatgatcgagcggaggaagcgctggcggaccatcaagctgctgctgcgccggggcgcggaccccaacctgtgctgcgtgcccatgcaggtcctgttccttgctgtgaaggccggggacgtggatggggtgaggctgctgctggagcacggggcgaggaccgacatctgctttccgccgcagctgagcaccctgacaccactccacatcgctgccgcccttcctggggaggagggggtacagattgtggagctgctgttgcatgccatcaccgatgtggacgccaaggcatccgacgaggacgacacttacaagcccggcaaggttgtgaaggagctcctgacccagggagctgaccccaacctgcccctgaccaaaggcttgggcagtgccctgtgtgttgcctgtgacctgacctacgagcaccagaggaacatggacagcaagctggccctgattgaccgactcatcagtcacggggccgacatcctgaagcctgtaatgctcaggcagggagaaaaggaggcagtgggcacagccgtggactatggctacttcagattcttccaggaccggaggattgcccgctgccccttccacacgctgatgccagcagagcgcgagacgttcctggcgcggaagcggctcctggagtacatgggcttgcagctacggcaggctgtctttgccaaggagagccagtgggaccccacgtggctgtacctgtgcaagagagcggagctgatccccagccacaggatgaagaagaagggccccagcctgcccaggggcctggatgtgaaggagcaggggcaaattcccttcttcaagttctgctaccagtgtggccgctccatcggggtccgcctcttgccctgccctcgctgctacgggatcctgacctgcagcaagtactgcaagaccaaggcctggaccgagttccacaagaaggactgcggggacctggtggccatcgtgacacaactggagcaagtttccaggaggagagaagaattccagtgaagcagcagctgcacgtccgaggcttggggaggacccaggactgtgtgggtttcttacctgcctgagccacctcagggaatcttccagcctaatgcaggcatttctgcacctttggggtcatgctttgtagcagtgtctcccttgcgacctcgcaataaattggccccacggggtgattttgacagtc

SEQ ID NO: 280584 - DNA, 663 bp, Homo sapiens
cggcctccatggcggcgcacgtgggctccaggtgcgccagcaggtcctcagccgggtcgtcgaacacgggcacgcgcagctctgccacgccgggcgcgcgcgggccgggctgctggcgggagacgttgacgcacagcgtgactcccgcgcgcgccagctgctcctccgcgcccgcggctggcgcgctcccgaggaagagtgagggcgcgacgcgcaccaacggtggaggtacgggcgaggcggccccgcggcgcccagcttctgccggtcccatggcgcccgccgaagagtctgcttttgggccctgaggatctattttgggggctcaggcgcccgcccaggagtctatttgtgggagccgggcgggccgccgggcgcccccgggtcctagaggcctccgaggtggaccaggctggggcttgggtcccccgcgggcgctgggccgggacagggggcttgggtctcgttggggccggggcatggcgggaggtttgggcctcaccagggcgccggggccttggaccgctctgcgtcccatgttctctgtccccgggcgccgtcctccccgcccccgcggcctgtggcactgggcttgcgtctgtggctcttgggcgcagcgccctgcccgctctactgcggcgtctggcgcggaggcgtccgctt

SEQ ID NO: 280585 - DNA, 416 bp, Homo sapiens
cctccgtgaagcccctgctttcaggggttagttctggagtggcccagccctggggccttcccctctgtcaggggaagtgacatggtggccactgatgagactgtctgtgtatgttcaggttgtgaaggagctcctgacccagggagctgaccccaacctgcccctgaccaaaggcttgggcagtgccctgtgtgttgcctgtgacctgacctacgagcaccagaggaacatggacagcaagctggccctgattgaccgactcatcagtcacggggccgacatcctgaagcctgagccacctcagggaatcttccagcctaatgcaggcatttctgcacctttggggtcatgctttgtagcagtgtctcccttgcgacctcgcaataaattggccccacggggtgattttgacagtc

SEQ ID NO: 280586 - DNA, 3870 bp, Homo sapiens
  misc_feature (2594)..(2594): n is a, c, g, or t
cggcctccatggcggcgcacgtgggctccaggtgcgccagcaggtcctcagccgggtcgtcgaacacgggcacgcgcagctctgccacgccgggcgcgcgcgggccgggctgctggcgggagacgttgacgcacagcgtgactcccgcgcgcgccagctgctcctccgcgcccgcggctggcgcgctcccgaggaagagtgagggcgcgacgcgcaccaacggtggagggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccaggggctatacaaagcggaccagcggtttgggccaggtgtcgagacctaccccgatggcagccaggacgtggggctgtggttccgagagcagctcatcaagctgtgcacccagatccccagtggcttctccctcctcagataccctgagttctccagcttcatcacccacagccctgccaggatcagcctctcagaagaggagaaaacggagtggggactgcaggagggacaggatccctttttctatgactataagcggtttcttctgaatgacaacctaacgctgcctccagaaatgtatgtctactcgaccaacagtgaccacctgcccatgacaagctctttccgcaaagagctggacgcccgcatcttcctcaatgaaattcctccgttcgttgaggatggagaaccatggttcataatcaatgagacccctttgttggtcaaaatccagaagcaaacttacaagttcaggaacaagccagctcacaccagctggaacatgggcgccatcctggaggggaagcgcagtggctttgcaccctgtgggcccaaagagcaactttccatggagatgatcctaaaggctgaggaagggaaccacgaatggatttgtaggatcctgaaggacaactttgctagtgctgacgtggcggacgcaaagggctacactgtgcttgctgcggctgctactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggaacctccaaaattcccagttgttccaatcctttcatcatcatttatggacacaaacctggagtctctgtactatgaggtgaacgtgccttcccagggtagctatgagctgaggccaccgccagcaccactgctcctgccacgcgtctcaggcagccacgagggcggccacttccaggacaccgggcagtgtggggggtccatagaccacaggagcagctctctgaagggggactccccgttggtgaagggcagccttggccatgtggaaagcgggcttgaggacgtgttgggaaacacagaccggggcagtctgtgcagtgctgagacgaaatttgagtccaacgtgtgtgtgtgcgacttctccatcgagctctcgcaggccatgctggagagaagcgcccagtcccacagcttgctgaagatggcctcgccctcaccgtgcaccagcagcttcgacaaagggaccatgcggaggatggcgctgtccatgatcgagtaggtcctggcaccagctggtgggggtggagggccaccatcagggctgaatcctatgctcagcagacccacgtctcttccctgtgccagtgggaggcgttgtgtctggagatgtgtgtctgaatgtgtgagcatccctgtgtcggtggctccacgccatggccagccctgtgggggtgccacggtgacgggctgttttcagtgccaccccagccctgtgggggtgccacggtgacgggctgttttcagtaccacgccagccctgctttggcctttggcactggcctgaagtgtctctgtgggagcctcagcaggggccactgtcaggggtcctatcctagccatagtgcacgtgagtgacacctgcctgggcagctctcacacccctgctgtccaccctgtctataccagtgtgtctcaaaatgtggtctatgcacccccgggggtccaagaccctttcagggagtctgtggggtcaaaatgattctcttgataaccctgagactctgttagccttctccttgtgttgatgttggtggatggtatgaagacagggccgtgcagaccaccagcccccagcgtgcagggcagcagtgcccggcctgcttgggggcatggtattccttcaccacggtgtgcacttgcggggatgcctgtctcactgaagaatgcctttgacnaagcagaaaagcaatgacaaattgcattaaatcttgctccttgcgtacacacccctcgaatattctgggtcggaaaacatgggaaggacactgatgtgtgtctgccacagaccaaggcacaccgcttccccgcaagaagcgcttcccccagggccagagtagcaacagaatgcggcatcttcccaacctcctgccccatttttgattggaagaatgaccactggtatgtggctgttcattctcctgaacacagcctgccactttaaggaaaacatatgacactatttgttgctggcgaaatttacattttcaagtgaatagcagaattctggacacttgccaccaccaccaagaccttcatagcttcccttaactttgagacatgggtgttcagaggtttttcacgtgagatggcgttagcagcgcagttttgtgatactgcctgaagacatgccgacagtgcccagatctcttctattggtgagccagcttttcccacacggccaagttctgatgttgaaccattgccaggtgggtgaagatccattgacagtgagaggtgggcccgtgggcttcagtgcagccaggcgcagaaggctggttcatgagtgtccagctccgccaggtagctagctcaccacccccagcctgggttcatgtagttcaaataggaagaccacgatgatcagaaaggctgctcaaatactccttcgtccagccgcgtacctgggggaggctgaatctccactcacttccaccaaggctgtgcagagcagataggggaatccagcaaaggtggaaaacagtgccatccttctccccaactggttttgttttgtaaaataactttttgtgacagtgttacttattagtaacatgcagtgggtttgttatggttaacaagttggtgagcattattgagaggtgaagccagctgagcttctgggttgggtggggacttggagaacttttgtgtctagctaaaggattgtaaatgcaccaatcaatgctcagtgtctagctaaaggattgtaaatgcaccaatcagcactctgtaaaattgaccaatcagcgttctgtaaaatggaccaatcagtggtctgtaaaatggaccagtcagcaggatgtgggcggggccaaaaaagggaataaaagctggccaccgccaggctccccaccagcctgcagcgacaacctgcttagtttcctttctgtgctgtggaagctttgttctttcagtcttcacaataaatcttgctgctgctcaaaaaaaggt

SEQ ID NO: 280587 - DNA, 3316 bp, Homo sapiens
cggcctccatggcggcgcacgtgggctccaggtgcgccagcaggtcctcagccgggtcgtcgaacacgggcacgcgcagctctgccacgccgggcgcgcgcgggccgggctgctggcgggagacgttgacgcacagcgtgactcccgcgcgcgccagctgctcctccgcgcccgcggctggcgcgctcccgaggaagagtgagggcgcgacgcgcaccaacggtggagggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccaggggctatacaaagcggaccagcggtttgggccaggtgtcgagacctaccccgatggcagccaggacgtggggctgtggttccgagagcagctcatcaagctgtgcacccagatccccagtggcttctccctcctcagataccctgagttctccagcttcatcacccacagccctgccaggatcagcctctcagaagaggagaaaacggagtggggactgcaggagggacaggatccctttttctatgactataagcggtttcttctgaatgacaacctaacgctgcctccagaaatgtatgtctactcgaccaacagtgaccacctgcccatgacaagctctttccgcaaagagctggacgcccgcatcttcctcaatgaaattcctccgttcgttgaggatggagaaccatggttcataatcaatgagacccctttgttggtcaaaatccagaagcaaacttacaagttcaggaacaagccagctcacaccagctggaacatgggcgccatcctggaggggaagcgcagtggctttgcaccctgtgggcccaaagagcaactttccatggagatgatcctaaaggctgaggaagggaaccacgaatggatttgtaggatcctgaaggacaactttgctagtgctgacgtggcggacgcaaagggctacactgtgcttgctgcggctgctactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggaacctccaaaattcccagttgttccaatcctttcatcatcatttatggacacaaacctggagtctctgtactatgaggtgaacgtgccttcccagggtagctatgagctgaggccaccgccagcaccactgctcctgccacgcgtctcaggcagccacgagggcggccacttccaggacaccgggcagtgtggggggtccatagaccacaggagcagctctctgaagggggactccccgttggtgaagggcagccttggccatgtggaaagcgggcttgaggacgtgttgggaaacacagaccggggcagtctgtgcagtgctgagacgaaatttgagtccaacgtgtgtgtgtgcgacttctccatcgagctctcgcaggccatgctggagagaagcgcccagtcccacagcttgctgaagatggcctcgccctcaccgtgcaccagcagcttcgacaaagggaccatgcggaggatggcgctgtccatgatcgagcggaggaagcgctggcggaccatcaagctgctgctgcgccggggcgcggaccccaacctgtgctgcgtgcccatgcaggtcctgttccttgctgtgaaggccggggacgtggatggggtgaggctgctgctggagcacggggcgaggaccgacatctgctttccgccgcagctgagcaccctgacaccactccacatcgctgccgcccttcctggggaggagggggtacagattgtggagctgctgttgcatgccatcaccgatgtggacgccaaggcatccgacgaggacgacacttacaagcccggcaagctggacctgctgccctcaagtctgaagctcagcaatgagccaggccctccccaagcctactacagcacggacacagccctcccggaggaggggggcaggacggctctgcacatggcctgcgagcgggaggatgacaacaagtgtgccagggacatagtccggctccttctatcccacggagcaaatcctaacctgctgtggagtggccactccccgctctccctgtccattgccagtgggaatgagctggttgtgaaggagctcctgacccagggagctgaccccaacctgcccctgaccaaaggcttgggcagtgccctgtgtgttgcctgtgacctgacctacgagcaccagaggaacatggacagcaagctggccctgattgaccgactcatcagtcacggggccgacatcctgaagcctgtaatgctcaggcagggagaaaaggaggcagtgggcacagccgtggactatggctacttcagattcttccaggaccggaggattgcccgctgccccttccacacgctgatgccagcagagcgcgagacgttcctggcgcggaagcggctcctggagtacatgggcttgcagctacggcaggctgtctttgccaaggagagccagtgggaccccacgtggctgtacctgtgcaagagagcggagctgatccccagccacaggatgaagaagaagggccccagcctgcccaggggcctggatgtgaaggagcaggggcaaattcccttcttcaagttctgctaccagtgtggccgctccatcggggtccgcctcttgccctgccctcgctgctacgggatcctgacctgcagcaagtactgcaagaccaaggcctggaccgagttccacaagaaggactgcggggacctggtggccatcgtgacacaactggagcaagtttccaggaggagagaagaattccagtgaagcagcagctgcacgtccgaggcttggggaggacccaggactgtgtgggtttcttacctgcctgagccacctcagggaatcttccagcctaatgcaggcatttctgcactaacacggccgcggtgcagggccctttagtac

SEQ ID NO: 280588 - DNA, 3180 bp, Homo sapiens
  misc_feature (1904)..(1904): n is a, c, g, or t
cggcctccatggcggcgcacgtgggctccaggtgcgccagcaggtcctcagccgggtcgtcgaacacgggcacgcgcagctctgccacgccgggcgcgcgcgggccgggctgctggcgggagacgttgacgcacagcgtgactcccgcgcgcgccagctgctcctccgcgcccgcggctggcgcgctcccgaggaagagtgagggcgcgacgcgcaccaacggtggagggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccagactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggaacctccaaaattcccagttgttccaatcctttcatcatcatttatggacacaaacctggagtctctgtactatgaggtgaacgtgccttcccagggtagctatgagctgaggccaccgccagcaccactgctcctgccacgcgtctcaggcagccacgagggcggccacttccaggacaccgggcagtgtggggggtccatagaccacaggagcagctctctgaagggggactccccgttggtgaagggcagccttggccatgtggaaagcgggcttgaggacgtgttgggaaacacagaccggggcagtctgtgcagtgctgagacgaaatttgagtccaacgtgtgtgtgtgcgacttctccatcgagctctcgcaggccatgctggagagaagcgcccagtcccacagcttgctgaagatggcctcgccctcaccgtgcaccagcagcttcgacaaagggaccatgcggaggatggcgctgtccatgatcgagtaggtcctggcaccagctggtgggggtggagggccaccatcagggctgaatcctatgctcagcagacccacgtctcttccctgtgccagtgggaggcgttgtgtctggagatgtgtgtctgaatgtgtgagcatccctgtgtcggtggctccacgccatggccagccctgtgggggtgccacggtgacgggctgttttcagtgccaccccagccctgtgggggtgccacggtgacgggctgttttcagtaccacgccagccctgctttggcctttggcactggcctgaagtgtctctgtgggagcctcagcaggggccactgtcaggggtcctatcctagccatagtgcacgtgagtgacacctgcctgggcagctctcacacccctgctgtccaccctgtctataccagtgtgtctcaaaatgtggtctatgcacccccgggggtccaagaccctttcagggagtctgtggggtcaaaatgattctcttgataaccctgagactctgttagccttctccttgtgttgatgttggtggatggtatgaagacagggccgtgcagaccaccagcccccagcgtgcagggcagcagtgcccggcctgcttgggggcatggtattccttcaccacggtgtgcacttgcggggatgcctgtctcactgaagaatgcctttgacnaagcagaaaagcaatgacaaattgcattaaatcttgctccttgcgtacacacccctcgaatattctgggtcggaaaacatgggaaggacactgatgtgtgtctgccacagaccaaggcacaccgcttccccgcaagaagcgcttcccccagggccagagtagcaacagaatgcggcatcttcccaacctcctgccccatttttgattggaagaatgaccactggtatgtggctgttcattctcctgaacacagcctgccactttaaggaaaacatatgacactatttgttgctggcgaaatttacattttcaagtgaatagcagaattctggacacttgccaccaccaccaagaccttcatagcttcccttaactttgagacatgggtgttcagaggtttttcacgtgagatggcgttagcagcgcagttttgtgatactgcctgaagacatgccgacagtgcccagatctcttctattggtgagccagcttttcccacacggccaagttctgatgttgaaccattgccaggtgggtgaagatccattgacagtgagaggtgggcccgtgggcttcagtgcagccaggcgcagaaggctggttcatgagtgtccagctccgccaggtagctagctcaccacccccagcctgggttcatgtagttcaaataggaagaccacgatgatcagaaaggctgctcaaatactccttcgtccagccgcgtacctgggggaggctgaatctccactcacttccaccaaggctgtgcagagcagataggggaatccagcaaaggtggaaaacagtgccatccttctccccaactggttttgttttgtaaaataactttttgtgacagtgttacttattagtaacatgcagtgggtttgttatggttaacaagttggtgagcattattgagaggtgaagccagctgagcttctgggttgggtggggacttggagaacttttgtgtctagctaaaggattgtaaatgcaccaatcaatgctcagtgtctagctaaaggattgtaaatgcaccaatcagcactctgtaaaattgaccaatcagcgttctgtaaaatggaccaatcagtggtctgtaaaatggaccagtcagcaggatgtgggcggggccaaaaaagggaataaaagctggccaccgccaggctccccaccagcctgcagcgacaacctgcttagtttcctttctgtgctgtggaagctttgttctttcagtcttcacaataaatcttgctgctgctcaaaaaaaggt

SEQ ID NO: 280589 - DNA, 531 bp, Homo sapiens
gagaagacagagagggagcctggctatcaggctgactgcctggtaacccctctgggtgcttcagttgccgactctaatagtcgcatgccaggcatccctgagttctgccacagccctgggtggtccccattcattgccaaccaggcatggtggctcagcctcaagggcatcccgtcaggttctggaagagcagcaatttctcaccaacttctccatctcacagtcataccatgggcagttttaccgggaccactgccatggcctgggtacctacatgtggccagatggctccagtttcacgggcacattttacctcagccaccgagaaggctacggcaccatgtacatgaagacacggcttttccaggtgagggggctgccatgtgttcagctggggtcgaagtggctgtgtgtgtctaagccactggacaaaaagatatttcggtcctggggaagtttatttgtttagctacaagtagcttttttacttttaatgattaaaatggtaccaataataaggatatagactga

SEQ ID NO: 280590 - DNA, 3675 bp, Homo sapiens
  misc_feature (2399)..(2399): n is a, c, g, or t
gagaagacagagagggagcctggctatcaggctgactgcctggtaacccctctgggtgcttcagttgccgactctaatagtcgcatgccaggcatccctgagttctgccacagccctgggtggtccccattcattgccaaccaggcatggtggctcagcctcaagggcatcccgtcaggttctggaagagcagcaatttctcaccaacttctccatctcacagtcataccatgggcagttttaccgggaccactgccatggcctgggtacctacatgtggccagatggctccagtttcacgggcacattttacctcagccaccgagaaggctacggcaccatgtacatgaagacacggcttttccaggggctatacaaagcggaccagcggtttgggccaggtgtcgagacctaccccgatggcagccaggacgtggggctgtggttccgagagcagctcatcaagctgtgcacccagatccccagtggcttctccctcctcagataccctgagttctccagcttcatcacccacagccctgccaggatcagcctctcagaagaggagaaaacggagtggggactgcaggagggacaggatccctttttctatgactataagcggtttcttctgaatgacaacctaacgctgcctccagaaatgtatgtctactcgaccaacagtgaccacctgcccatgacaagctctttccgcaaagagctggacgcccgcatcttcctcaatgaaattcctccgttcgttgaggatggagaaccatggttcataatcaatgagacccctttgttggtcaaaatccagaagcaaacttacaagttcaggaacaagccagctcacaccagctggaacatgggcgccatcctggaggggaagcgcagtggctttgcaccctgtgggcccaaagagcaactttccatggagatgatcctaaaggctgaggaagggaaccacgaatggatttgtaggatcctgaaggacaactttgctagtgctgacgtggcggacgcaaagggctacactgtgcttgctgcggctgctactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggaacctccaaaattcccagttgttccaatcctttcatcatcatttatggacacaaacctggagtctctgtactatgaggtgaacgtgccttcccagggtagctatgagctgaggccaccgccagcaccactgctcctgccacgcgtctcaggcagccacgagggcggccacttccaggacaccgggcagtgtggggggtccatagaccacaggagcagctctctgaagggggactccccgttggtgaagggcagccttggccatgtggaaagcgggcttgaggacgtgttgggaaacacagaccggggcagtctgtgcagtgctgagacgaaatttgagtccaacgtgtgtgtgtgcgacttctccatcgagctctcgcaggccatgctggagagaagcgcccagtcccacagcttgctgaagatggcctcgccctcaccgtgcaccagcagcttcgacaaagggaccatgcggaggatggcgctgtccatgatcgagtaggtcctggcaccagctggtgggggtggagggccaccatcagggctgaatcctatgctcagcagacccacgtctcttccctgtgccagtgggaggcgttgtgtctggagatgtgtgtctgaatgtgtgagcatccctgtgtcggtggctccacgccatggccagccctgtgggggtgccacggtgacgggctgttttcagtgccaccccagccctgtgggggtgccacggtgacgggctgttttcagtaccacgccagccctgctttggcctttggcactggcctgaagtgtctctgtgggagcctcagcaggggccactgtcaggggtcctatcctagccatagtgcacgtgagtgacacctgcctgggcagctctcacacccctgctgtccaccctgtctataccagtgtgtctcaaaatgtggtctatgcacccccgggggtccaagaccctttcagggagtctgtggggtcaaaatgattctcttgataaccctgagactctgttagccttctccttgtgttgatgttggtggatggtatgaagacagggccgtgcagaccaccagcccccagcgtgcagggcagcagtgcccggcctgcttgggggcatggtattccttcaccacggtgtgcacttgcggggatgcctgtctcactgaagaatgcctttgacnaagcagaaaagcaatgacaaattgcattaaatcttgctccttgcgtacacacccctcgaatattctgggtcggaaaacatgggaaggacactgatgtgtgtctgccacagaccaaggcacaccgcttccccgcaagaagcgcttcccccagggccagagtagcaacagaatgcggcatcttcccaacctcctgccccatttttgattggaagaatgaccactggtatgtggctgttcattctcctgaacacagcctgccactttaaggaaaacatatgacactatttgttgctggcgaaatttacattttcaagtgaatagcagaattctggacacttgccaccaccaccaagaccttcatagcttcccttaactttgagacatgggtgttcagaggtttttcacgtgagatggcgttagcagcgcagttttgtgatactgcctgaagacatgccgacagtgcccagatctcttctattggtgagccagcttttcccacacggccaagttctgatgttgaaccattgccaggtgggtgaagatccattgacagtgagaggtgggcccgtgggcttcagtgcagccaggcgcagaaggctggttcatgagtgtccagctccgccaggtagctagctcaccacccccagcctgggttcatgtagttcaaataggaagaccacgatgatcagaaaggctgctcaaatactccttcgtccagccgcgtacctgggggaggctgaatctccactcacttccaccaaggctgtgcagagcagataggggaatccagcaaaggtggaaaacagtgccatccttctccccaactggttttgttttgtaaaataactttttgtgacagtgttacttattagtaacatgcagtgggtttgttatggttaacaagttggtgagcattattgagaggtgaagccagctgagcttctgggttgggtggggacttggagaacttttgtgtctagctaaaggattgtaaatgcaccaatcaatgctcagtgtctagctaaaggattgtaaatgcaccaatcagcactctgtaaaattgaccaatcagcgttctgtaaaatggaccaatcagtggtctgtaaaatggaccagtcagcaggatgtgggcggggccaaaaaagggaataaaagctggccaccgccaggctccccaccagcctgcagcgacaacctgcttagtttcctttctgtgctgtggaagctttgttctttcagtcttcacaataaatcttgctgctgctcaaaaaaaggt

SEQ ID NO: 280591 - DNA, 1052 bp, Homo sapiens
tgttctaatagggcagccttgaacataccaggaagcaataggaaaaaactggagaaagtgaaaaggctgcgatgaaggaaaagaggagacaaacaagggtgacattggctgggcagcaaagatgaccaaaaggccaagaagcctgtgctgttccagtattgatccggtgctcctccgtcaccatccgaccacagaacctcaggctgatagttgttcactaactcatagagctctggcaatgtcttagaaactggaaattgccgcttatggaatgaactggattcatcctcaaggaagagcggatgaaaccattcaaaaagggaatagtacagtccaaaacgcagcttgggaaagttcctagacatcaggaaatcagcatgttctcaagcaaatacacttgatagacattcatctcagcaggataaatatctacaggagaaaatcatgaagctaccagaatgtggccaaagggaaaaatatcctatgatcattccagattttttgtgttggttctcctctcctattcccatcccatccctggagaaaacaataaggcaaagtttcccgttttttttttttttttttttggagacaggatctccctccgccacctagactggagtgtagtaagcctatctccgctcactgcagcctcaagcagtcctccaacctaagcctcccaagtagctgggactacagagacataccactacgctaattttttagtttttgtttgtttgtgtgtttttgtagagacagggtctcactatgttgcccaggctggtcttgaacccctgggctcaaatgatcctccttcctcggcctcccaaaattttgggattacagacatgagcgaccacatccagtgcaaatttttttataccaaggcaaagatgatcatgcaaaagaaactaatgaatgaacaagccgttggaacaaaaacaatttgttaatgcttccctggccttacaaatactggagtggtaatgggtggaatccattctattaaaatagaatggattttaaatgtgtgggggtttagatattcttct

SEQ ID NO: 280592 - DNA, 376 bp, Homo sapiens
tgttctaatagggcagccttgaacataccaggaagcaataggaaaaaactggagaaagtgaaaaggctgcgatgaaggaaaagaggagacaaacaagggtgacattggctgggcagcaaagatgaccaaaaggtaagaggataaaaagaagcagtctgcgggattcagaagcaaatagtcagaaatagtgatgaagaaacagagttgtcccagaatagaggccataaaggaccagggtaggagagaaaaaggggggacccacaaaattaacaccttcaaagttcttgatcctgtgatttttagtctgatctcaaaatcagaccattgagttggattttactcctgatttatttacccttgattatgttgagtaaat

SEQ ID NO: 280593 - DNA, 454 bp, Homo sapiens
tctgtgcagtccacagcctggtttgactgcacctcatgaggcgcaggccacagccttccccctccttggcagaggagagatgaggctgctgcagggatctcctgagctggccatctgcaggtcccttgctctgctgcccacctccctgccctgtctggcctcagtgagtcctcttggcgatgtctccctccaggttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcacctggcagcatagatccttaggtgctcaataaaggtgtgctgtattgaactgaa

SEQ ID NO: 280594 - DNA, 2488 bp, Homo sapiens
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 280595 - DNA, 4000 bp, Homo sapiens
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcgaagctcttaggtgtgcaggttgggcgggggagtcttcacatttgccatccccctcatcctgggcagcctttaggtggaggggttctgagcacttgttcagagatctgatggggtgccctgggggacagtgatggggtgcttctttttgagcctgtccaataggggatccccaagctacacatgaccatggctgggaggcatgggcaatagaaaagaggctccagatggcaggcactttatacgaaataggtgtgtacagggcctcattataacttttacattgattgcatgttgacaaatagtaatttagatatattgagttcaataaaatgtgttattaatgctaatttcacctgtttcattttcccctctgtattaggccattcttgtgttgctataaagaaatacctgaagctgggtaatttacaaagaaaagagatttagttggctcacggttctggaggctttacaagaagtgtggtgctggcatctgctcggcttccagggaggcctcaaggagcctccagtcatgttggaaggcgaacggggagcaggcacttcacatggcgaaagcaggagcaagagagagggagtggagggtggtgccacacacttttaaatgaccagacctcgtgtgaactcagagcaaaagctcacttatcaccacggggatggcccaagccactcatgagggatctgctcccatgatccaaacacctcccacctggccccacctccaacactgggaattacaattccacatgagatttgggtggggacacacatccaaaccatatcacctcctaacatgtactagaagattgaaattaccagtgtggctcacatcccacgtctgctggccccacagccccacagagcccagcttgggttcaggcagctgtccaggcctccccttcctccaacattagccagggctgtggctttcccttcgggaagggagacagcgttgagggaaagtggcttactgcagacttcagggccttactcacagggccatcaccttccactgcgcctttggaaagtcagggtggggaagaagcaggcacccctcagggtggcccgcagcagccacagcaggccttgtaggaagtgatatggggaaaagcaagaggctgtacaatgccaaaagcaagtccagggcatttactgtgaggaagcaacgcaggtggagggcagggaggctgccagggccttacctgtgatagtgaaagtgtcggcaccctggacatcctggaccagacgcaggcctgtcccgtgagtctcgcctcctcctcagcccgacccccatgccccccaccagggccatgtgcagaaccatccgggtgcattgcgatggcagtctggtctcctctggttatgcctggccggcgagaagggtgctgtcacactcctgttacaaatgaggaaacagaggccagggaagccaaaggccagaagctgaggccctgccacaccctaggagtacatgtgcgtctttccctttttaggtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 280596 - DNA, 2515 bp, Homo sapiens
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcgaagctcttaggtgtgcaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctgggctgctggtctcttctccttggcctgagctccctttctctgccggcagccatctcagccctgcagttgtctgttttcagaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 280597 - DNA, 3908 bp, Homo sapiens
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcgaagctcttaggtgtgcaggttgggcgggggagtcttcacatttgccatccccctcatcctgggcagcctttaggtggaggggttctgagcacttgttcagagatctgatggggtgccctgggggacagtgatggggtgcttctttttgagcctgtccaataggggatccccaagctacacatgaccatggctgggaggcatgggcaatagaaaagaggctccagatggcaggcactttatacgaaataggtgtgtacagggcctcattataacttttacattgattgcatgttgacaaatagtaatttagatatattgagttcaataaaatgtgttattaatgctaatttcacctgtttcattttcccctctgtattaggccattcttgtgttgctataaagaaatacctgaagctgggtaatttacaaagaaaagagatttagttggctcacggttctggaggctttacaagaagtgtggtgctggcatctgctcggcttccagggaggcctcaaggagcctccagtcatgttggaaggcgaacggggagcaggcacttcacatggcgaaagcaggagcaagagagagggagtggagggtggtgccacacacttttaaatgaccagacctcgtgtgaactcagagcaaaagctcacttatcaccacggggatggcccaagccactcatgagggatctgctcccatgatccaaacacctcccacctggccccacctccaacactgggaattacaattccacatgagatttgggtggggacacacatccaaaccatatcacctcctaacatgtactagaagattgaaattaccagtgtggctcacatcccacgtctgctggccccacagccccacagagcccagcttgggttcaggcagctgtccaggcctccccttcctccaacattagccagggctgtggctttcccttcgggaagggagacagcgttgagggaaagtggcttactgcagacttcagggccttactcacagggccatcaccttccactgcgcctttggaaagtcagggtggggaagaagcaggcacccctcagggtggcccgcagcagccacagcaggccttgtaggaagtgatatggggaaaagcaagaggctgtacaatgccaaaagcaagtccagggcatttactgtgaggaagcaacgcaggtggagggcagggaggctgccagggccttacctgtgatagtgaaagtgtcggcaccctggacatcctggaccagacgcaggcctgtcccgtgagtctcgcctcctcctcagcccgacccccatgccccccaccagggccatgtgcagaaccatccgggtgcattgcgatggcagtctggtctcctctggttatgcctggccggcgagaagggtgctgtcacactcctgttacaaatgaggaaacagaggccagggaagccaaaggccagaagctgaggccctgccacaccctaggagtacatgtgcgtctttccctttttaggtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 280598 - DNA, 4053 bp, Homo sapiens
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcgaagctcttaggtgtgcaggttgggcgggggagtcttcacatttgccatccccctcatcctgggcagcctttaggtggaggggttctgagcacttgttcagagatctgatggggtgccctgggggacagtgatggggtgcttctttttgagcctgtccaataggggatccccaagctacacatgaccatggctgggaggcatgggcaatagaaaagaggctccagatggcaggcactttatacgaaataggtgtgtacagggcctcattataacttttacattgattgcatgttgacaaatagtaatttagatatattgagttcaataaaatgtgttattaatgctaatttcacctgtttcattttcccctctgtattaggccattcttgtgttgctataaagaaatacctgaagctgggtaatttacaaagaaaagagatttagttggctcacggttctggaggctttacaagaagtgtggtgctggcatctgctcggcttccagggaggcctcaaggagcctccagtcatgttggaaggcgaacggggagcaggcacttcacatggcgaaagcaggagcaagagagagggagtggagggtggtgccacacacttttaaatgaccagacctcgtgtgaactcagagcaaaagctcacttatcaccacggggatggcccaagccactcatgagggatctgctcccatgatccaaacacctcccacctggccccacctccaacactgggaattacaattccacatgagatttgggtggggacacacatccaaaccatatcacctcctaacatgtactagaagattgaaattaccagtgtggctcacatcccacgtctgctggccccacagccccacagagcccagcttgggttcaggcagctgtccaggcctccccttcctccaacattagccagggctgtggctttcccttcgggaagggagacagcgttgagggaaagtggcttactgcagacttcagggccttactcacagggccatcaccttccactgcgcctttggaaagtcagggtggggaagaagcaggcacccctcagggtggcccgcagcagccacagcaggccttgtaggaagtgatatggggaaaagcaagaggctgtacaatgccaaaagcaagtccagggcatttactgtgaggaagcaacgcaggtggagggcagggaggctgccagggccttacctgtgatagtgaaagtgtcggcaccctggacatcctggaccagacgcaggcctgtcccgtgagtctcgcctcctcctcagcccgacccccatgccccccaccagggccatgtgcagaaccatccgggtgcattgcgatggcagtctggtctcctctggttatgcctggccggcgagaagggtgctgtcacactcctgttacaaatgaggaaacagaggccagggaagccaaaggccagaagctgaggccctgccacaccctaggagtacatgtgcgtctttccctttttaggtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttaggttctctcccatctccaagcaccgtgatctgacttcctgtgactgcctgtgcaggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 280599 - DNA, 2423 bp, Homo sapiens
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 280600 - DNA, 1639 bp, Homo sapiens
tctgtgcagtccacagcctggtttgactgcacctcatgaggcgcaggccacagccttccccctccttggcagaggagagatgaggctgctgcagggatctcctgagctggccatctgcaggtcccttgctctgctgcccacctccctgccctgtctggcctcagtgagtcctcttggcgatgtctccctccaggttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 280601 - DNA, 1538 bp, Homo sapiens
  misc_feature (56)..(56): n is a, c, g, or t
acgggctatggggtagtcgagtacgtcggggcattccggataggcgagaaagtgtngtgggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 280602 - DNA, 1415 bp, Homo sapiens
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgacaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 280603 - DNA, 2247 bp, Homo sapiens
  misc_feature (2045)..(2045): n is a, c, g, or t
  misc_feature (2073)..(2073): n is a, c, g, or t
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcgaagctcttaggtgtgcaggttgggcgggggagtcttcacatttgccatccccctcatcctgggcagcctttaggtggaggggttctgagcacttgttcagagatctgatggggtgccctgggggacagtgatggggtgcttctttttgagcctgtccaataggggatccccaagctacacatgaccatggctgggaggcatgggcaatagaaaagaggctccagatggcaggcactttatacgaaataggtgtgtacagggcctcattataacttttacattgattgcatgttgacaaatagtaatttagatatattgagttcaataaaatgtgttattaatgctaatttcacctgtttcattttcccctctgtattaggccattcttgtgttgctataaagaaatacctgaagctgggtaatttacaaagaaaagagatttagttggctcacggttctggaggctttacaagaagtgtggtgctggcatctgctcggcttccagggaggcctcaaggagcctccagtcatgttggaaggcgaacggggagcaggcacttcacatggcgaaagcaggagcaagagagagggagtggagggtggtgccacacacttttaaatgaccagacctcgtgtgaactcagagcaaaagctcacttatcaccacggggatggcccaagccactcatgagggatctgctcccatgatccaaacacctcccacctggccccacctccaacactgggaattacaattccacatgagatttgggtggggacacacatccaaaccatatcacctcctaacatgtactagaagattgaaattaccagtgtggctcacatcccacgtctgctggccccacagccccacagagcccagcttgggttcaggcagctgtccaggcctccccttcctccaacattagccagggctgtggctttcccttcgggaagggagacagcgttgagggaaagtggcttactgcagacttcagggccttactcacagggccatcaccttccactgcgcctttggaaagtcagggtggggaagaagcaggcacccctcagggtggcccgcagcagccacagcaggccttgtaggaagtgatatggggaaaagcaagaggctgtacaatgccaaaagcaagtccagggcatttactgtgaggaagcaacgcaggtggagggcagggaggctgccagggccttacctgtgatagtgaaagtgtcggcaccctggacatcctggaccagacgcaggcctgtcccgtgagtctcgcctcctcctcagcccgacccccatgccccccaccagggccatgtgcagaaccatccgggtgcattgcgatggcagtctggtctcctctggttatgcctggccggcgagaagggtgctgtcacactcctgttacaaatgaggaaacagaggccagggaagccaaaggccagaagctgaggccctgccacaccctaggagtacatgtgcgtctttccctttttaggtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggccctcttgaaggaaaaagttnatattttaaggacacattttatattaantgtttgaatttcattttcagttttcatgtttcaaactgagtaattaacatttgtcttatgtatacagatattgctaagccaatatagtgtatctcaacaggtaccggatttaatatcttttgagaatgcgtatgatgaacgttagtgcctgtaagtcgatcccgtgggccaact

SEQ ID NO: 280604 - DNA, 461 bp, Homo sapiens
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctactgactctcgtggtttgaaatccaggcctcacctcagcctgc

SEQ ID NO: 280605 - DNA, 358 bp, Homo sapiens
cagcctatggatccgtgaccaatgtgagggtcaacagcaccatgacaaccctgcaggtgctcaccctgctgctgaacaaatttagggtaagcctggtcaggagcagccttgccccaggatgccagtggtctgctattctgttgggggtggggttctggggaaagctgcccgtggcagaagctgcctgggcagaaggtctagcaagggtccctctgctgagctttggtttctcggatttcaagcaagaggaggttgggagaggacaggttccttgcaacttgcgtgtgtgttactgggggtgtagttactgtcaggggaccctctcagttctctcccatctccaagcaccgtgatctga

SEQ ID NO: 280606 - DNA, 419 bp, Homo sapiens
taggtcgctcagtacattaagtttaattctttcaggattctgaaggagaatcccaccaagctataggaagcctccctctccgcctcttccagagaaatggatgggtgggtacctagctccttggcgccgagtcaggaagggtggggtgcgtgtcgcagtgcatcaggccctggccctcccgtctcagctttcctttctcccacccctcagatcttgtttctcttcaagctgcacctttgctgaatgacactgtaggggaggaaaattatcttctctttctacccatttaggttcactggctggggccctgtatttagattaacaaaagacagattaaggagaagaacaaacagaagtttgttaacacttgcatcatgcatgccctttggaatatccagggatgaatggtcagaatttgg

SEQ ID NO: 280607 - DNA, 430 bp, Homo sapiens
atttttgtaaaccaccttctttttcagagcggacaaaattaaaagactgcgagtacccgctgatttccagaatcctgcatgggccatgtgagaagatcgccaggatcttcctgatggaagctgacttgggcgtggaagtcccccatgaagtgagtgggggccaaggctggggaggcctgctctagggtgaggggttcttgggtgacggggcctcccaaggactcctggccagagccctgtcagttgatgtctccaggagctccacactctcccaaagggctcccagcctagcacagggaggcgccagccctccctctcccatcagtgaccgccagcaccagcagcttaggggaaagaagaatttgggtcctataaaaccatggcctgtccttttcctctagggaagtaaagtcttttccttcattggaat

SEQ ID NO: 280608 - DNA, 235 bp, Homo sapiens
gcggccgcctactactactactactgctcgaattcaagcttctaacgatgtacggggacatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 280609 - DNA, 2865 bp, Homo sapiens
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaaaaaaaaaaaaaaaaaaaaaaaaaaaaaaaaaaaaaaaaacaaaaaaaaaaaaaaaaaaagaagaaaaaagaaagacagagaacaacaagaaggagggcgggcggagccgaaacaaaatactaccccggaggggagggccacaaaagagaggagacacaccaccgtagttgcaggcaaaagcaaggggggcaacccactagagcagcggagcagactaaaaacaaaccacagcggcagcgggcgggcactcaacaacacacgagtaggagacagggaggaaaccacgacgcagtcagacgagaacatagcaggagagagaacacacaacaaccacggggcggcagcagaacaatacagacgaaaaccaaccaacaaat

SEQ ID NO: 280610 - DNA, 2524 bp, Homo sapiens
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagctcagtgacacatctgtgcttgtagagcaccagaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 280611 - DNA, 2557 bp, Homo sapiens
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctgggggattctgaaggagaatcccaccaagctataggaagcctccctctccgcctcttccagagaaatggatggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 280612 - DNA, 2196 bp, Homo sapiens
ggccatgtgacattgtgacccaggttaccctgtctgggtctcaccttcctatctgcaagctgggaatatccagcctccagtccaggaatggccctcacgtccccatctgccccagtgcacgtgaccacagggctctagggtgccagatctcccgacagcaggcagttgctctgtcagcatcacccaccctgccattctctcacccatttctcatgcagggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 280613 - DNA, 1969 bp, Homo sapiens
gggcttcagtttcgggacgtgctgtgcaggttcctctggtgccctctccaggctgaggaggggctcgggttgtctctggtgattaactccatcattgcctagagagggacgggggcacaccttgacaaatttatgtcctgctttttggcaaataggggagggcaaagagcctcacttgtatcttcttcttctcaattgccagccgctccacttaatccttatgccaaagtggcagatctgggggccctgttctgcctcccttctgcatgagcaggaatctctcagggcagcgctgttagcgagagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 280614 - DNA, 1450 bp, Homo sapiens
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 280615 - DNA, 1226 bp, Homo sapiens
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtgagtgggggccaaggctggggaggcctgctctagggtgaggggttcttgggtgacggggcctcccaaggactcctggccagagccctgtcagttgatgtctccaggagctccacactctcccaaagggctcccagcctagcacagggaggcgccagccctccctctcccatcagtgaccgccagcaccagcagcttaggggaaagaagaatttgggtcctataaaaccatggcctgtccttttcctctagggaagtaaagtcttttccttcattggaatg

SEQ ID NO: 280616 - DNA, 2578 bp, Homo sapiens
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcgaagctcttaggtgtgcaggttgggcgggggagtcttcacatttgccatccccctcatcctgggcagcctttaggtggaggggttctgagcacttgttcagagatctgatggggtgccctgggggacagtgatggggtgcttctttttgagcctgtccaataggggatccccaagctacacatgaccatggctgggaggcatgggcaatagaaaagaggctccagatggcaggcactttatacgaaataggtgtgtacagggcctcattataacttttacattgattgcatgttgacaaatagtaatttagatatattgagttcaataaaatgtgttattaatgctaatttcacctgtttcattttcccctctgtattaggccattcttgtgttgctataaagaaatacctgaagctgggtaatttacaaagaaaagagatttagttggctcacggttctggaggctttacaagaagtgtggtgctggcatctgctcggcttccagggaggcctcaaggagcctccagtcatgttggaaggcgaacggggagcaggcacttcacatggcgaaagcaggagcaagagagagggagtggagggtggtgccacacacttttaaatgaccagacctcgtgtgaactcagagcaaaagctcacttatcaccacggggatggcccaagccactcatgagggatctgctcccatgatccaaacacctcccacctggccccacctccaacactgggaattacaattccacatgagatttgggtggggacacacatccaaaccatatcacctcctaacatgtactagaagattgaaattaccagtgtggctcacatcccacgtctgctggccccacagccccacagagcccagcttgggttcaggcagctgtccaggcctccccttcctccaacattagccagggctgtggctttcccttcgggaagggagacagcgttgagggaaagtggcttactgcagacttcagggccttactcacagggccatcaccttccactgcgcctttggaaagtcagggtggggaagaagcaggcacccctcagggtggcccgcagcagccacagcaggccttgtaggaagtgatatggggaaaagcaagaggctgtacaatgccaaaagcaagtccagggcatttactgtgaggaagcaacgcaggtggagggcagggaggctgccagggccttacctgtgatagtgaaagtgtcggcaccctggacatcctggaccagacgcaggcctgtcccgtgagtctcgcctcctcctcagcccgacccccatgccccccaccagggccatgtgcagaaccatccgggtgcattgcgatggcagtctggtctcctctggttatgcctggccggcgagaagggtgctgtcacactcctgttacaaatgaggaaacagaggccagggaagccaaaggccagaagctgaggccctgccacaccctaggagtacatgtgcgtctttccctttttaggtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttaggggaagatggccccagtgagttcgaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctca

SEQ ID NO: 280617 - DNA, 595 bp, Homo sapiens
agcgggaggcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctccaccttgctggcaagaagggacgactacagccaggggggctcccaacacctatgcaagccgaacatgtctcgccatctcttgttctatctttaaaattcacacgaatttagcctcttactactctgttttcattttaatgtcaaaattttaaaaataaatttatcagaatttcaca

SEQ ID NO: 280618 - DNA, 3054 bp, Homo sapiens
ccagcctccgctaggggaccccctccatggcttcccaccgggttgttccaggcctcagcttcgccgaaaggcctcaccacctccgacctccgcctgccctggggatgctcccagccctgctgcggcagaacgcgacatgctaaccggaatccctaggccgcctgtctcctacccatacttagaggccccgctcagacggtccttaaaacgtctgaaaggccgttcctgccagagtccctgctacctgttacctccacccctatttagtcctagtggacagcctcgctcaccttccctgggatgacacttctggcggctgagatgagcgagcctctctgggctctgccgccgggtgtgggctgacctgcctacagctggggcctgataaggcagcagcaaaagggtggaggggaggcagtgttgaagctggggcaagtaattttccccaatttacagggaaaaaccgaaattcagaaaagtttaatgtcacccaggggctggagcccagacctctggcagctctcactttcacaatgcccttgggctgactaggctgcagaggggtttcaccccaaccccagggcacctcaagtgtccccaccaaaccttcctaacacctgtccactaagctgtactaggcccttgcaactgacctatgggacctgaggcctggcccctcatggctcctgtcaccaggtctcaggtcagggtccagcaggccctgagctgacgtgtggagccagagccacccaatcccgtagggacaggtttcacaacttcccggatggggctgtggtgggtcacagtgcagcctccagccagaaggatggggtggctcccactcctgctgcttctgactcaatgcttaggggtccctgggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccgaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatccctcatcagcaccgatttacgccagaaaaatacgcgtgcaaagaccttcgggagaacttctgccggaaccccgacggctcagaggcgccctggtgcttcacactgcggcccggcatgcgcgcggccttttgctaccagatccggcgttgtacagacgacgtgcggccccaggactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggcagggccagcatttctgcggggggtctctagtgaaggagcagtggatactgactgcccggcagtgcttctcctcctgccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttaggcccagccttgatgccatatgccttggggaggacaaaacttcttgtcagacataaagccatgtttcctctttatgcctgtaaaaaaaaaact

SEQ ID NO: 280619 - DNA, 3273 bp, Homo sapiens
ccagcctccgctaggggaccccctccatggcttcccaccgggttgttccaggcctcagcttcgccgaaaggcctcaccacctccgacctccgcctgccctggggatgctcccagccctgctgcggcagaacgcgacatgctaaccggaatccctaggccgcctgtctcctacccatacttagaggccccgctcagacggtccttaaaacgtctgaaaggccgttcctgccagagtccctgctacctgttacctccacccctatttagtcctagtggacagcctcgctcaccttccctgggatgacacttctggcggctgagatgagcgagcctctctgggctctgccgccgggtgtgggctgacctgcctacagctggggcctgataaggcagcagcaaaagggtggaggggaggcagtgttgaagctggggcaagtaattttccccaatttacagggaaaaaccgaaattcagaaaagtttaatgtcacccaggggctggagcccagacctctggcagctctcactttcacaatgcccttgggctgactaggctgcagaggggtttcaccccaaccccagggcacctcaagtgtccccaccaaaccttcctaacacctgtccactaagctgtactaggcccttgcaactgacctatgggacctgaggcctggcccctcatggctcctgtcaccaggtctcaggtcagggtccagcaggccctgagctgacgtgtggagccagagccacccaatcccgtagggacaggtttcacaacttcccggatggggctgtggtgggtcacagtgcagcctccagccagaaggatggggtggctcccactcctgctgcttctgactcaatgcttaggggtccctgggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccgaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatccctcatcagcaccgatttacgccagaaaaatacgcgtgcaagtgaggtggggggggggggcgggcgttgggacgtgctgctgcgggtgagacgggaggaaggtagtcacgggctcaaggctggaggctggcgggctagggctgagtggagcgcctgcttagagaccttcgggagaacttctgccggaaccccgacggctcagaggcgccctggtgcttcacactgcggcccggcatgcgcgcggccttttgctaccagatccggcgttgtacagacgacgtgcggccccagggtgaggcccaagcttgggggctacagagccgggctggaagcctggaaccggagggccggggcgaggtctcggcctgatggctgcccgcacccgccacagactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggcagggccagcatttctgcggggggtctctagtgaaggagcagtggatactgactgcccggcagtgcttctcctcctgccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttaggcccagccttgatgccatatgccttggggaggacaaaacttcttgtcagacataaagccatgtttcctctttatgcctgtaaaaaaaaaact

SEQ ID NO: 280620 - DNA, 3473 bp, Homo sapiens
ccagcctccgctaggggaccccctccatggcttcccaccgggttgttccaggcctcagcttcgccgaaaggcctcaccacctccgacctccgcctgccctggggatgctcccagccctgctgcggcagaacgcgacatgctaaccggaatccctaggccgcctgtctcctacccatacttagaggccccgctcagacggtccttaaaacgtctgaaaggccgttcctgccagagtccctgctacctgttacctccacccctatttagtcctagtggacagcctcgctcaccttccctgggatgacacttctggcggctgagatgagcgagcctctctgggctctgccgccgggtgtgggctgacctgcctacagctggggcctgataaggcagcagcaaaagggtggaggggaggcagtgttgaagctggggcaagtaattttccccaatttacagggaaaaaccgaaattcagaaaagtttaatgtcacccaggggctggagcccagacctctggcagctctcactttcacaatgcccttgggctgactaggctgcagaggggtttcaccccaaccccagggcacctcaagtgtccccaccaaaccttcctaacacctgtccactaagctgtactaggcccttgcaactgacctatgggacctgaggcctggcccctcatggctcctgtcaccaggtctcaggtcagggtccagcaggccctgagctgacgtgtggagccagagccacccaatcccgtagggacaggtttcacaacttcccggatggggctgtggtgggtcacagtgcagcctccagccagaaggatggggtggctcccactcctgctgcttctgactcaatgcttaggggtccctgggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccgaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatccctcatcagcaccgatttacgccagaaaaatacgcgtgcaagtgaggtggggggggggggcgggcgttgggacgtgctgctgcgggtgagacgggaggaaggtagtcacgggctcaaggctggaggctggcgggctagggctgagtggagcgcctgcttagagaccttcgggagaacttctgccggaaccccgacggctcagaggcgccctggtgcttcacactgcggcccggcatgcgcgcggccttttgctaccagatccggcgttgtacagacgacgtgcggccccaggactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggtgaggcacaactgcctgtctcccacagagaggagctgaggttgtgtcctctgtggttatcccactgggggctgggaatctatccctgcccccagaggtcctagccagaagatggcaggtctagcatctgtcccaggagtctgttacctgtcctaattccccactcctctaggcagggccagcatttctgcggggggtctctagtgaaggagcagtggatactgactgcccggcagtgcttctcctcctggtgagcctcccttgtgtttggggacccagtctcatcccaccttcccccttccccaggcaagctaacaagtgagccttggggcaatggactgagagtcacaaatgacctagcagagcttctctcccagccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttaggcccagccttgatgccatatgccttggggaggacaaaacttcttgtcagacataaagccatgtttcctctttatgcctgtaaaaaaaaaact

SEQ ID NO: 280621 - DNA, 3346 bp, Homo sapiens
ccagcctccgctaggggaccccctccatggcttcccaccgggttgttccaggcctcagcttcgccgaaaggcctcaccacctccgacctccgcctgccctggggatgctcccagccctgctgcggcagaacgcgacatgctaaccggaatccctaggccgcctgtctcctacccatacttagaggccccgctcagacggtccttaaaacgtctgaaaggccgttcctgccagagtccctgctacctgttacctccacccctatttagtcctagtggacagcctcgctcaccttccctgggatgacacttctggcggctgagatgagcgagcctctctgggctctgccgccgggtgtgggctgacctgcctacagctggggcctgataaggcagcagcaaaagggtggaggggaggcagtgttgaagctggggcaagtaattttccccaatttacagggaaaaaccgaaattcagaaaagtttaatgtcacccaggggctggagcccagacctctggcagctctcactttcacaatgcccttgggctgactaggctgcagaggggtttcaccccaaccccagggcacctcaagtgtccccaccaaaccttcctaacacctgtccactaagctgtactaggcccttgcaactgacctatgggacctgaggcctggcccctcatggctcctgtcaccaggtctcaggtcagggtccagcaggccctgagctgacgtgtggagccagagccacccaatcccgtagggacaggtttcacaacttcccggatggggctgtggtgggtcacagtgcagcctccagccagaaggatggggtggctcccactcctgctgcttctgactcaatgcttaggggtccctgggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccgaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatccctcatcagcaccgatttacgccagaaaaatacgcgtgcaagtgaggtggggggggggggcgggcgttgggacgtgctgctgcgggtgagacgggaggaaggtagtcacgggctcaaggctggaggctggcgggctagggctgagtggagcgcctgcttagagaccttcgggagaacttctgccggaaccccgacggctcagaggcgccctggtgcttcacactgcggcccggcatgcgcgcggccttttgctaccagatccggcgttgtacagacgacgtgcggccccaggactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggtgaggcacaactgcctgtctcccacagagaggagctgaggttgtgtcctctgtggttatcccactgggggctgggaatctatccctgcccccagaggtcctagccagaagatggcaggtctagcatctgtcccaggagtctgttacctgtcctaattccccactcctctaggcagggccagcatttctgcggggggtctctagtgaaggagcagtggatactgactgcccggcagtgcttctcctcctgccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttaggcccagccttgatgccatatgccttggggaggacaaaacttcttgtcagacataaagccatgtttcctctttatgcctgtaaaaaaaaaact

SEQ ID NO: 280622 - DNA, 3219 bp, Homo sapiens
  misc_feature (2961)..(2961): n is a, c, g, or t
  misc_feature (3005)..(3005): n is a, c, g, or t
  misc_feature (3010)..(3011): n is a, c, g, or t
  misc_feature (3095)..(3096): n is a, c, g, or t
  misc_feature (3100)..(3100): n is a, c, g, or t
  misc_feature (3102)..(3102): n is a, c, g, or t
  misc_feature (3124)..(3124): n is a, c, g, or t
  misc_feature (3127)..(3127): n is a, c, g, or t
  misc_feature (3149)..(3149): n is a, c, g, or t
  misc_feature (3155)..(3155): n is a, c, g, or t
  misc_feature (3158)..(3158): n is a, c, g, or t
  misc_feature (3188)..(3189): n is a, c, g, or t
  misc_feature (3194)..(3195): n is a, c, g, or t
  misc_feature (3204)..(3204): n is a, c, g, or t
ccagcctccgctaggggaccccctccatggcttcccaccgggttgttccaggcctcagcttcgccgaaaggcctcaccacctccgacctccgcctgccctggggatgctcccagccctgctgcggcagaacgcgacatgctaaccggaatccctaggccgcctgtctcctacccatacttagaggccccgctcagacggtccttaaaacgtctgaaaggccgttcctgccagagtccctgctacctgttacctccacccctatttagtcctagtggacagcctcgctcaccttccctgggatgacacttctggcggctgagatgagcgagcctctctgggctctgccgccgggtgtgggctgacctgcctacagctggggcctgataaggcagcagcaaaagggtggaggggaggcagtgttgaagctggggcaagtaattttccccaatttacagggaaaaaccgaaattcagaaaagtttaatgtcacccaggggctggagcccagacctctggcagctctcactttcacaatgcccttgggctgactaggctgcagaggggtttcaccccaaccccagggcacctcaagtgtccccaccaaaccttcctaacacctgtccactaagctgtactaggcccttgcaactgacctatgggacctgaggcctggcccctcatggctcctgtcaccaggtctcaggtcagggtccagcaggccctgagctgacgtgtggagccagagccacccaatcccgtagggacaggtttcacaacttcccggatggggctgtggtgggtcacagtgcagcctccagccagaaggatggggtggctcccactcctgctgcttctgactcaatgcttaggggtccctgggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccgaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatccctcatcagcaccgatttacgccagaaaaatacgcgtgcaagtgaggtggggggggggggcgggcgttgggacgtgctgctgcgggtgagacgggaggaaggtagtcacgggctcaaggctggaggctggcgggctagggctgagtggagcgcctgcttagagaccttcgggagaacttctgccggaaccccgacggctcagaggcgccctggtgcttcacactgcggcccggcatgcgcgcggccttttgctaccagatccggcgttgtacagacgacgtgcggccccaggactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggcagggccagcatttctgcggggggtctctagtgaaggagcagtggatactgactgcccggcagtgcttctcctcctggtgagcctcccttgtgtttggggacccagtctcatcccaccttcccccttccccaggcaagctaacaagtgagccttggggcaatggactgagagtcacaaatgacctagcagagcttctctcccagccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtaagagcacagtgcacaggactgctggtccccgtggacgatcaggcgaaaccngccctgctggtcctcctggtcctggaccccctggtctccaggtnccccnngccctggcatcgacatgtacgcctttgctgcttaggcccgagagagaagggccccgaccccctgcagtacatgcgggccgaccnngcangncggtgcctgagacagcatgacnccnaggtggatgccacactcaagtncctcancanccagattgagagcattcgcaggcccgaggnntccgnnagccctgcntggacttgcgacttg

SEQ ID NO: 280623 - DNA, 3174 bp, Homo sapiens
ccagcctccgctaggggaccccctccatggcttcccaccgggttgttccaggcctcagcttcgccgaaaggcctcaccacctccgacctccgcctgccctggggatgctcccagccctgctgcggcagaacgcgacatgctaaccggaatccctaggccgcctgtctcctacccatacttagaggccccgctcagacggtccttaaaacgtctgaaaggccgttcctgccagagtccctgctacctgttacctccacccctatttagtcctagtggacagcctcgctcaccttccctgggatgacacttctggcggctgagatgagcgagcctctctgggctctgccgccgggtgtgggctgacctgcctacagctggggcctgataaggcagcagcaaaagggtggaggggaggcagtgttgaagctggggcaagtaattttccccaatttacagggaaaaaccgaaattcagaaaagtttaatgtcacccaggggctggagcccagacctctggcagctctcactttcacaatgcccttgggctgactaggctgcagaggggtttcaccccaaccccagggcacctcaagtgtccccaccaaaccttcctaacacctgtccactaagctgtactaggcccttgcaactgacctatgggacctgaggcctggcccctcatggctcctgtcaccaggtctcaggtcagggtccagcaggccctgagctgacgtgtggagccagagccacccaatcccgtagggacaggtttcacaacttcccggatggggctgtggtgggtcacagtgcagcctccagccagaaggatggggtggctcccactcctgctgcttctgactcaatgcttaggggtccctgggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccgaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatccctcatcagcaccgatttacgccagaaaaatacgcgtgcaagtgaggtggggggggggggcgggcgttgggacgtgctgctgcgggtgagacgggaggaaggtagtcacgggctcaaggctggaggctggcgggctagggctgagtggagcgcctgcttagagaccttcgggagaacttctgccggaaccccgacggctcagaggcgccctggtgcttcacactgcggcccggcatgcgcgcggccttttgctaccagatccggcgttgtacagacgacgtgcggccccaggactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggcagggccagcatttctgcggggggtctctagtgaaggagcagtggatactgactgcccggcagtgcttctcctcctgccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttaggcccagccttgatgccatatgccttggggaggacaaaacttcttgtcagacataaagccatgtttcctctttatgcctgtaaaaaaaaaact

SEQ ID NO: 280624 - DNA, 3153 bp, Homo sapiens
ccagcctccgctaggggaccccctccatggcttcccaccgggttgttccaggcctcagcttcgccgaaaggcctcaccacctccgacctccgcctgccctggggatgctcccagccctgctgcggcagaacgcgacatgctaaccggaatccctaggccgcctgtctcctacccatacttagaggccccgctcagacggtccttaaaacgtctgaaaggccgttcctgccagagtccctgctacctgttacctccacccctatttagtcctagtggacagcctcgctcaccttccctgggatgacacttctggcggctgagatgagcgagcctctctgggctctgccgccgggtgtgggctgacctgcctacagctggggcctgataaggcagcagcaaaagggtggaggggaggcagtgttgaagctggggcaagtaattttccccaatttacagggaaaaaccgaaattcagaaaagtttaatgtcacccaggggctggagcccagacctctggcagctctcactttcacaatgcccttgggctgactaggctgcagaggggtttcaccccaaccccagggcacctcaagtgtccccaccaaaccttcctaacacctgtccactaagctgtactaggcccttgcaactgacctatgggacctgaggcctggcccctcatggctcctgtcaccaggtctcaggtcagggtccagcaggccctgagctgacgtgtggagccagagccacccaatcccgtagggacaggtttcacaacttcccggatggggctgtggtgggtcacagtgcagcctccagccagaaggatggggtggctcccactcctgctgcttctgactcaatgcttaggggtccctgggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccgaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatccctcatcagcaccgatttacgccagaaaaatacgcgtgcaaagaccttcgggagaacttctgccggaaccccgacggctcagaggcgccctggtgcttcacactgcggcccggcatgcgcgcggccttttgctaccagatccggcgttgtacagacgacgtgcggccccagggtgaggcccaagcttgggggctacagagccgggctggaagcctggaaccggagggccggggcgaggtctcggcctgatggctgcccgcacccgccacagactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggcagggccagcatttctgcggggggtctctagtgaaggagcagtggatactgactgcccggcagtgcttctcctcctgccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttaggcccagccttgatgccatatgccttggggaggacaaaacttcttgtcagacataaagccatgtttcctctttatgcctgtaaaaaaaaaact

SEQ ID NO: 280625 - DNA, 1689 bp, Homo sapiens
ttgttcacgccccattaccgcccccaggttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatccctcatcagcaccgatttacgccagaaaaatacgcgtgcaagtgaggtggggggggggggcgggcgttgggacgtgctgctgcgggtgagacgggaggaaggtagtcacgggctcaaggctggaggctggcgggctagggctgagtggagcgcctgcttagagaccttcgggagaacttctgccggaaccccgacggctcagaggcgccctggtgcttcacactgcggcccggcatgcgcgcggccttttgctaccagatccggcgttgtacagacgacgtgcggccccaggactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggcagggccagcatttctgcggggggtctctagtgaaggagcagtggatactgactgcccggcagtgcttctcctcctgccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttaggcccagccttgatgccatatgccttggggaggacaaaacttcttgtcagacataaagccatgtttcctctttatgcctgtaaaaaaaaaact

SEQ ID NO: 280626 - DNA, 454 bp, Homo sapiens
taagagcacagtgcacaggactgctggtggccaggaggcccagccctggatcttcctgcaggaccctctccctctccccattcccctcactgcaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgaggttggtggcagggccctgggccagccctggaagggtatggggggctagaaatgaactattttatcatgaagcaggctagtcattgctgtggcccggggccctcatcagttctcctacctgccagggtgactacgggggcccacttgcctgctttacccacaactgctgggtcctggaaggaattataatccccaaccgagtatgcgcaaggtcccgctg

SEQ ID NO: 280627 - DNA, 382 bp, Homo sapiens
ctacctcctgatcctcaggcctgctaccagacccggggaccagggacaaacagcacgatagggtagggcaggaaaaagtggcccctcagtcctgttggggacggccagacctacttgattatgtgggccctggatccctctcctttccctgggctttgagaactacttagcatccatccctgacctagactgcttctgggctacccctgctctccactgaggtttcctcgtctgtgcaggcacatcacacaccggacaccaggacccaagcccagcagacacaggatctgctaacgcagctggcagctgaggtggctatcgatgaaagctggaaaggaggaggcccagtcttccaagtatcgggatactctagaacagcatg

SEQ ID NO: 280628 - DNA, 3533 bp, Homo sapiens
aggcgcagaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtgggcggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggaggcgagtcttccctccccgagggctgcagggccagggaggagaggagggaaaagcgcgggacttaacgtccaaagacttggtcttacggctcctttccagctgtgtggttttgatgaagtcattgatcctcagtttccatttctgtaaaatggggctaacattctctcgctttcagggtttatgtgagggtccactgaagtgctttaggtgagagttccctataaactgtaaagcgcgctgccgtcgtttttgcaaagctactcttttctgtcggcccagtgtagcatctggcggttttcttctctccaccctgctcctccgaagcgcggtgtccatcacaccaagcccgttactccctctgctctgaaatcttccccatcccgcagcctgcccttctccaggtcgctggagttagattaccacacttcctcctgcttccggggcaccatggtgaaggctgactgtcctgtccctatcacagacctgccagattcctctggtaaactgcaggttccctctgcctcagttgtggccagggattctgaccaggagatgatgggaactagatggagtaaattagtgtcacgcaggaaggcaggaccgtgcagcattcaccaacctggattttggagtcagcgttcaaatctgagctctgctgtcttattgaggcggtgaccttggtttggataagttatgtaacctctctggccctctcaaaataaggataatcacggttggcatcaagattaagtaaaataatgtgtgtaaattgtaaggaataaatcacatgatgaatgttaagtactgggtttagtgcctggcacatagtaagtgcttaataaatggaggctattgttagcccatcctgagccaagcctccctccatctctgcaagagcagaggaggcatcggctctgccctgtctctctgattctcctttgtggaagagtcagtggcctgaaatactgggctttatctatctgtcttctacatccctgggtcagggaattgaagacagggtagaaagcatgggaattttgtataaaccttcatttggcttgaataaggtactggaaaccgaggaattgctttactcaccatccctaggccttaggggccccactcctcttcttcctcccagcagctggtcataacttcagtgacttctctctgtgtgtgcttggagagtccctgggagcagcctgcaggggcgggtgagagggggatctcccgcttcatgtttcttgtagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagctgccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattggg

SEQ ID NO: 280629 - DNA, 2780 bp, Homo sapiens
aggcgcagaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtgggcggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagctgccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattgggaaaaaaaaaaaaaaaaaaaaaaaaaaaaaaaaacaaaaacaaaaaaacacacaccacacaacaaaactctctctctctctctctctctctctcgccgccgcgcgcgcggtgttgcgtctcccacaaaaagagcagcactctccacggtgtgtgggagagaacaaacacagagggggcgcgagtgtgtgtggtgaggagtacaaaaagagagaggaggggccccctctctgtgtgtgagattatttttggtgggcgccttctcctcgaaaagaggaggcttctttggagtggggtgtcttacgaggagaacgcgcggtcgatgtgtgtcccaccaaaaaaaaacagaaaagacgagggtgtgtggggaggtcacactcacacacactcgagaattatttattggggggagagggagagaggtgggcacacaagagaaggaggcgggagagtaaattatttgcgagcaacaagaggagaggcgacccacacggagttga

SEQ ID NO: 280630 - DNA, 2918 bp, Homo sapiens
aggcgcagaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccacgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccaaagctactcttttctgtcggcccagtgtagcatctggcggttttcttctctccaccctgctcctccgaagcgcggtgtccatcacaccaagcccgttactccctctgctctgaaatcttccccatcccgcagcctgcccttctccaggtcgctggagttagattaccacacttcctcctgcttccggggcaccatggtgaaggctgactgtcctgtccctatcacagacctgccagattcctctggtaaactgcaggttccctctgcctcagttgtggccagggattctgaccaggagatgatgggaactagatggagtaaattagtgtcacgcaggaaggcaggaccgtgcagcattcaccaacctggattttggagtcagcgttcaaatctgagctctgctgtcttattgaggcggtgaccttggtttggataagttatgtaacctctctggccctctcaaaataaggataatcacggttggcatcaagattaagtaaaataatgtgtgtaaattgtaaggaataaatcacatgatgaatgttaagtactgggtttagtgcctggcacatagtaagtgcttaataaatggaggctattgttagcccatcctgagccaagcctccctccatctctgcaagagcagaggaggcatcggctctgccctgtctctctgattctcctttgtggaagagtcagtggcctgaaatactgggctttatctatctgtcttctacatccctgggtcagggaattgaagacagggtagaaagcatgggaattttgtataaaccttcatttggcttgaataaggtactggaaaccgaggaattgctttactcaccatccctaggccttaggggccccactcctcttcttcctcccagcagctggtcataacttcagtgacttctctctgtgtgtgcttggagagtccctgggagcagcctgcaggggcgggtgagagggggatctcccgcttcatgtttcttgtagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagctgccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattggg

SEQ ID NO: 280631 - DNA, 1753 bp, Homo sapiens
aactccgtatatatcgtctctatccggtagtctctctatacttagtctccctattcttaatctctctatccttaatctctctatccttaatctctggaaaccgaggaattgctttactcaccatccctaggccttaggggccccactcctcttcttcctcccagcagctggtcataacttcagtgacttctctctgtgtgtgcttggagagtccctgggagcagcctgcaggggcgggtgagagggggatctcccgcttcatgtttcttgtagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagctgccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattggg

SEQ ID NO: 280632 - DNA, 1740 bp, Homo sapiens
  misc_feature (56)..(56): n is a, c, g, or t
ccaagtggtcaccacctcaagaactataagaagcgtgtggcagccttggaagccanagcaaaagcccagcacttcccagagccagggactgacacaacagaaagtctgcaagcaatgccatgaggtcctgaccagagggtcttctgccaatgcctccaagtggtcaccacctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagctgccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattggg

SEQ ID NO: 280633 - DNA, 2649 bp, Homo sapiens
aggcgcagaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtgggcggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagctgccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccggtgggtgcaggtggaatgttctgtgcgagagctcaagggctgcctggatccctgacttgtatccctttgttccacagagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggggacgagtgggcttctattaaagcagatggatgaaggtgaggggggagacagatgaattagggtgagccgaatggttaggaagcctcctggtaggtgtataatgtgttaaaaaataaaaaaaaaaaaaaaaaaaaaaaaaaaaatttattggtgacgttgaagaaaagggctgaggggtggatggctggagctggggctacgtaggcggcccctcctggtcttcctgctgcatccgtgcgatcagctgttgccgctcggccgcctggcgcatgcgcatcatgacgaggctctcgtagtccctctctgacagcactgagccctttgacagtcctgagtggctgcggcccacggcatcctggggctgtccctccaaccaggaaatcttcagagggttatccaccaggccaacttcattctggacagcctgctttgcacccaggggatacctctaga

SEQ ID NO: 280634 - DNA, 1536 bp, Homo sapiens
  misc_feature (56)..(56): n is a, c, g, or t
ccaagtggtcaccacctcaagaactataagaagcgtgtggcagccttggaagccanagcaaaagcccagcacttcccagagccagggactgacacaacagaaagtctgcaagcaatgccatgaggtcctgaccagagggtcttctgccaatgcctccaagtggtcaccacctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagtgaccctccaggactatcgcctcccagacagtgatgacgacgaggatgaggagacagccatccaaagagtcctgcagcagctcactgaagaagctgccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattggg

SEQ ID NO: 280635 - DNA, 2766 bp, Homo sapiens
aggcgcagaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtgggcggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggaggcgagtcttccctccccgagggctgcagggccagggaggagaggagggaaaagcgcgggacttaacgtccaaagacttggtcttacggctcctttccagctgtgtggttttgatgaagtcattgatcctcagtttccatttctgtaaaatggggctaacattctctcgctttcagggtttatgtgagggtccactgaagtgctttaggtgagagttccctataaactgtaaagcgcgctgccgtcgtttttgcaaagctactcttttctgtcggcccagtgtagcatctggcggttttcttctctccaccctgctcctccgaagcgcggtgtccatcacaccaagcccgttactccctctgctctgaaatcttccccatcccgcagcctgcccttctccaggtcgctggagttagattaccacacttcctcctgcttccggggcaccatggtgaaggctgactgtcctgtccctatcacagacctgccagattcctctggtaaactgcaggttccctctgcctcagttgtggccagggattctgaccaggagatgatgggaactagatggagtaaattagtgtcacgcaggaaggcaggaccgtgcagcattcaccaacctggattttggagtcagcgttcaaatctgagctctgctgtcttattgaggcggtgaccttggtttggataagttatgtaacctctctggccctctcaaaataaggataatcacggttggcatcaagattaagtaaaataatgtgtgtaaattgtaaggaataaatcacatgatgaatgttaagtactgggtttagtgcctggcacatagtaagtgcttaataaatggaggctattgttagcccatcctgagccaagcctccctccatctctgcaagagcagaggaggcatcggctctgccctgtctctctgattctcctttgtggaagagtcagtggcctgaaatactgggctttatctatctgtcttctacatccctgggtcagggaattgaagacagggtagaaagcatgggaattttgtataaaccttcatttggcttgaataaggtactggaaaccgaggaattgctttactcaccatccctaggccttaggggccccactcctcttcttcctcccagcagctggtcataacttcagtgacttctctctgtgtgtgcttggagagtccctgggagcagcctgcaggggcgggtgagagggggatctcccgcttcatgtttcttgtagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccagtgagcaggggcagatggggttgcctagaggacacagtccagggcttctgggactgagatgcctctggcccttacaaggcttcccccatgccaattgcagagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggtgagtgttatggcttaggagagaagcgggggtgctagcgggaggacccagcagaagcccagatacaggtattggggtgatacaaaagtaattgtggtttttgtcattacttttaattgcaaaaacctcagttacttttgcaccaacctttgtactttatgtactttgcaggagt

SEQ ID NO: 280636 - DNA, 300 bp, Homo sapiens
aggcatgatggggagagaccagactgaatctacgggtgagccctgtaacctggctctagggcacaggcccctcccctggcacttagtgggtctaataaagtatgttgattcattgggcccagcatctcatttctacaaccctatgagcctgggccctgtgagaggtggcaggaacagagcaggctgtaagcacagttgtggggaatgggggaaaaggttgagccatcctatgaacttctccaggcaggaacagccctacccatcctggtggcctcatacgaagtaaacatgtattcattc

SEQ ID NO: 280637 - DNA, 2283 bp, Homo sapiens
aggcgcagaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtgggcggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagctgccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattggg

SEQ ID NO: 280638 - DNA, 2236 bp, Homo sapiens
aggcgcagaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtgggcggggcggggcagggcagggaagggaagggcggagctggggtgagggtccaaggggcccaggacttggccggcgtgatctcagctctgcagaccctgcggtgctgggagccaccatggagatacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagctgccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattggg

SEQ ID NO: 280639 - DNA, 2082 bp, Homo sapiens
aggcgcagaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagctgccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattggg

SEQ ID NO: 280640 - DNA, 2360 bp, Homo sapiens
aggcgcagaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtgggcggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagctgccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccggtgggtgcaggtggaatgttctgtgcgagagctcaagggctgcctggatccctgacttgtatccctttgttccacagagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattggg

SEQ ID NO: 280641 - DNA, 3329 bp, Homo sapiens
aggcgcagaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtgggcggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggaggcgagtcttccctccccgagggctgcagggccagggaggagaggagggaaaagcgcgggacttaacgtccaaagacttggtcttacggctcctttccagctgtgtggttttgatgaagtcattgatcctcagtttccatttctgtaaaatggggctaacattctctcgctttcagggtttatgtgagggtccactgaagtgctttaggtgagagttccctataaactgtaaagcgcgctgccgtcgtttttgcaaagctactcttttctgtcggcccagtgtagcatctggcggttttcttctctccaccctgctcctccgaagcgcggtgtccatcacaccaagcccgttactccctctgctctgaaatcttccccatcccgcagcctgcccttctccaggtcgctggagttagattaccacacttcctcctgcttccggggcaccatggtgaaggctgactgtcctgtccctatcacagacctgccagattcctctggtaaactgcaggttccctctgcctcagttgtggccagggattctgaccaggagatgatgggaactagatggagtaaattagtgtcacgcaggaaggcaggaccgtgcagcattcaccaacctggattttggagtcagcgttcaaatctgagctctgctgtcttattgaggcggtgaccttggtttggataagttatgtaacctctctggccctctcaaaataaggataatcacggttggcatcaagattaagtaaaataatgtgtgtaaattgtaaggaataaatcacatgatgaatgttaagtactgggtttagtgcctggcacatagtaagtgcttaataaatggaggctattgttagcccatcctgagccaagcctccctccatctctgcaagagcagaggaggcatcggctctgccctgtctctctgattctcctttgtggaagagtcagtggcctgaaatactgggctttatctatctgtcttctacatccctgggtcagggaattgaagacagggtagaaagcatgggaattttgtataaaccttcatttggcttgaataaggtactggaaaccgaggaattgctttactcaccatccctaggccttaggggccccactcctcttcttcctcccagcagctggtcataacttcagtgacttctctctgtgtgtgcttggagagtccctgggagcagcctgcaggggcgggtgagagggggatctcccgcttcatgtttcttgtagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagtgaccctccaggactatcgcctcccagacagtgatgacgacgaggatgaggagacagccatccaaagagtcctgcagcagctcactgaagaagctgccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattggg

SEQ ID NO: 280642 - DNA, 2572 bp, Homo sapiens
aggcgcagaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtgggcggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagctgccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggggacgagtgggcttctattaaagcagatggatgaaggtgaggggggagacagatgaattagggtgagccgaatggttaggaagcctcctggtaggtgtataatgtgttaaaaaataaaaaaaaaaaaaaaaaaaaaaaaaaaaatttattggtgacgttgaagaaaagggctgaggggtggatggctggagctggggctacgtaggcggcccctcctggtcttcctgctgcatccgtgcgatcagctgttgccgctcggccgcctggcgcatgcgcatcatgacgaggctctcgtagtccctctctgacagcactgagccctttgacagtcctgagtggctgcggcccacggcatcctggggctgtccctccaaccaggaaatcttcagagggttatccaccaggccaacttcattctggacagcctgctttgcacccaggggatacctctaga

SEQ ID NO: 280643 - DNA, 1843 bp, Homo sapiens
aggcgcagaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtgggcggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcccctctcgcaagagggtctctttgttcaattttttttaatttaaaatgattgtgcctctgccca

SEQ ID NO: 280644 - DNA, 2915 bp, Homo sapiens
aggcgcagaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtgggcggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggaggcgagtcttccctccccgagggctgcagggccagggaggagaggagggaaaagcgcgggacttaacgtccaaagacttggtcttacggctcctttccagctgtgtggttttgatgaagtcattgatcctcagtttccatttctgtaaaatggggctaacattctctcgctttcagggtttatgtgagggtccactgaagtgctttaggtgagagttccctataaactgtaaagcgcgctgccgtcgtttttgcaaagctactcttttctgtcggcccagtgtagcatctggcggttttcttctctccaccctgctcctccgaagcgcggtgtccatcacaccaagcccgttactccctctgctctgaaatcttccccatcccgcagcctgcccttctccaggtcgctggagttagattaccacacttcctcctgcttccggggcaccatggtgaaggctgactgtcctgtccctatcacagacctgccagattcctctggtaaactgcaggttccctctgcctcagttgtggccagggattctgaccaggagatgatgggaactagatggagtaaattagtgtcacgcaggaaggcaggaccgtgcagcattcaccaacctggattttggagtcagcgttcaaatctgagctctgctgtcttattgaggcggtgaccttggtttggataagttatgtaacctctctggccctctcaaaataaggataatcacggttggcatcaagattaagtaaaataatgtgtgtaaattgtaaggaataaatcacatgatgaatgttaagtactgggtttagtgcctggcacatagtaagtgcttaataaatggaggctattgttagcccatcctgagccaagcctccctccatctctgcaagagcagaggaggcatcggctctgccctgtctctctgattctcctttgtggaagagtcagtggcctgaaatactgggctttatctatctgtcttctacatccctgggtcagggaattgaagacagggtagaaagcatgggaattttgtataaaccttcatttggcttgaataaggtactggaaaccgaggaattgctttactcaccatccctaggccttaggggccccactcctcttcttcctcccagcagctggtcataacttcagtgacttctctctgtgtgtgcttggagagtccctgggagcagcctgcaggggcgggtgagagggggatctcccgcttcatgtttcttgtagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagaacccctccacttggctccctaggaatctgccctacctctttccccagactggagaggctctgctgtccaccctctgggagatgaatataaatcggagagtgatcaacgttataagagttaccattcattgagtgcttactccaaagggagccagtgtaagcctagtgtttaagtgcacgggctttagaatcagacagtgattcccatttctaccacgtattagctgtgtgatgctggacaagttacttgacctaagtctcactttcctcatgtgtaaaatgaaggtatgtatggaaaaacctacctcacaggga

SEQ ID NO: 280645 - DNA, 2666 bp, Homo sapiens
aggcgcagaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtgggcggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggaggcgagtcttccctccccgagggctgcagggccagggaggagaggagggaaaagcgcgggacttaacgtccaaagacttggtcttacggctcctttccagctgtgtggttttgatgaagtcattgatcctcagtttccatttctgtaaaatggggctaacattctctcgctttcagggtttatgtgagggtccactgaagtgctttaggtgagagttccctataaactgtaaagcgcgctgccgtcgtttttgcaaagctactcttttctgtcggcccagtgtagcatctggcggttttcttctctccaccctgctcctccgaagcgcggtgtccatcacaccaagcccgttactccctctgctctgaaatcttccccatcccgcagcctgcccttctccaggtcgctggagttagattaccacacttcctcctgcttccggggcaccatggtgaaggctgactgtcctgtccctatcacagacctgccagattcctctggtaaactgcaggttccctctgcctcagttgtggccagggattctgaccaggagatgatgggaactagatggagtaaattagtgtcacgcaggaaggcaggaccgtgcagcattcaccaacctggattttggagtcagcgttcaaatctgagctctgctgtcttattgaggcggtgaccttggtttggataagttatgtaacctctctggccctctcaaaataaggataatcacggttggcatcaagattaagtaaaataatgtgtgtaaattgtaaggaataaatcacatgatgaatgttaagtactgggtttagtgcctggcacatagtaagtgcttaataaatggaggctattgttagcccatcctgagccaagcctccctccatctctgcaagagcagaggaggcatcggctctgccctgtctctctgattctcctttgtggaagagtcagtggcctgaaatactgggctttatctatctgtcttctacatccctgggtcagggaattgaagacagggtagaaagcatgggaattttgtataaaccttcatttggcttgaataaggtactggaaaccgaggaattgctttactcaccatccctaggccttaggggccccactcctcttcttcctcccagcagctggtcataacttcagtgacttctctctgtgtgtgcttggagagtccctgggagcagcctgcaggggcgggtgagagggggatctcccgcttcatgtttcttgtagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggtgagtgttatggcttaggagagaagcgggggtgctagcgggaggacccagcagaagcccagatacaggtattggggtgatacaaaagtaattgtggtttttgtcattacttttaattgcaaaaacctcagttacttttgcaccaacctttgtactttatgtactttgcaggagt

SEQ ID NO: 280646 - DNA, 4000 bp, Homo sapiens
tgcaggtgaggtgaagtgaggtcgagggtggtgttgggccggtgctgctgccgctgccgccggggaggaggtggaaagcggggctgtggcgggccggcgggggcggcctgtcagccgctgctttgtctccttagctcgggtcccttctgcgctgccgcagggaggccgcccgggccaggcgagccgaaccaatgctggacctggaggtagtgcccgaacgctctctggggaacgagcaatgggaattcacgctgggaatgcctctggctcaggcagtagccattcttcagaagcactgtcgcatcatcaaaaacgtccaggttctctacagtgaacagtctcctctaagccatgacctcattcttaacctgactcaggacgggatcaaactaatgtttgatgctttcaatcagagacttaaggtgatcgaagtatgtgatttgactaaagtaaagttaaaatattgtggcgtgcattttaattctcaggccatagctcctaccattgaacagattgaccagtcttttggcgcaacccatcctggagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaaggctcccatgatgcctctgagctgtttcctgggcaatgtctatgctgagagtgtagatgttcttcgagatggaactggacctgcaggtttacgacttcgcctacttgctgcaggttgtggacctggcctattagcagatgccaagatgcgggtatttgaacgttcagtgtattttggtgattcctgccaagatgttcttagcatgcttggctctccacacaaagtcttctataaatcagaagacaagatgaaaattcattctccttcccctcataaacaagttccatcgaagtgtaatgactacttttttaactacttcactcttggagtggacatcctctttgatgcgaatacacacaaagtgaagaagtttgttctacacaccaattaccctgggcattataatttcaacatgtgagtacacctgtctgtacctcccctctgtgaagtgagttttgggctgaaaaccccaggaaagagcttttggctttgggtgttcactaatttatctacacctgaattcttgctgtttcatgggaagtgaatttcctgagtgcttgctgtgttcctggcacagggtccaatgccttacatctctctgtttgaacccattttacaaatagggaaataagttcagaaagcttgatgtcttatccaaggtaataggctctccagaacccagggccaagatcttttctgttcgacttccgtgcctaaatctggcctcccccagtgaacactgtcaggcactcagagccagggctttgggcaggtgtgtttggttctgtttctcctggggtgtggggttggaatatgggagtggccaggccttctaggaggcccagcctttacccatttgccttctctctagttatcatcgctgtgagttcaagatcccactagccataaagaaagaaaacgcagatggtcagacagaaacatgcacgacctacagcaagtgggacaacatccaggagctcctgggccaccctgtggagaagcctgttgtcctgcacaggtcttcctccccaaacaacaccaacccatttggttccacattctgctttggtcttcagcgaatgatctttgaggtcatgcagaacaaccacattgcctcggtgaccctgtatggcccccccaggcctggtagccacctgagaacagcggaactcccctagggacaccaccacccatgcccctctgtcccgtggaactgtgcatcacatcctgctcagtgggcctctgtaccaccctgtgggttttcttggacacctggccagtgctgaagggctgttgtgatgttctgaggttgggctcaggctgggtgctctgccatgggctgagtggcccagatattcttctgtccatctttggcctgctggtgccagcaggggacacagactgcaaagagaagcacaaagtttgagccttgattcctggacccaggagctctcaactaacaaggaggcaggagaggtcaacccttgtcccatgcacattgggaagacttggggctctttctgtgactgaggacacaggcacccaggataaggacaaggtcctgcctttggctccacattgccacatgacccttaaggcaagcaggtagcgtgtccatagtacttggttgcgacatttgcactacatccactttagttacttgatgagctggctgtggccagggtggcccacctgcccttccctgttcctttcttgcacgcgctccctgcctgggcacaccaaactggttgaaacacagctttctaccatccaggtacatgcccaggcctggttctcacccctgttggagtcagctttcaagattgcctgtgcccctgctctgccccatcctggctggcagggctgcatgtttccatcctgtttgcctcttttatttaatgccaaagttttagccaaagacatcttcctacttttgttgtgtttcagcattctgttctgcactgtgggctggctctctgccccaaccctgggcactggcccctggctgggccatttcatggctcaaagcctctgggggctcaaggaaggctgggctgctcagtcccttcatgggtcttgctaatggaaagtagcatatatgtgctttaaaaatattaatccttttgaaaagaactgagaagaaaaatgtataattttatcccatttttaatattttggtctagcaacttgtgatacatagatgacaattttgtgagtttttcaaatgtgtgtacagatttttgtaaatatgactcttttgtaattaactcatgtacagcctcatcctgtatagtttaatgatgaatgtgcaggggacctgtctcaggctcctatatggttcctgggccttatagccaggtttgtgtggcgctcccgacttttgtgactgactggtgtcttcccatttggactgtggcctggccagagccccttgcatatccccactgtcaggggcagccaggactgttcccatcctcctggaatgggggaaccttccttatcccctgcccacatcccctctccaataaagcacctgtgccctcagcaatggcctgccatgtgctgttgctgggatgtttgtattaaggtaagtgtgggtattggttttttgagcaagggggtggttgaagcatatggggaaattaatagtggtggcatctcaggggaagacattccttggctcctctgaggggatacagcctccagtgggagactggcattgttgtgtgagttcaggaggtgaggaaagactaggtaggaccgtgcactcatttgtcccttatgtgtggctccatccctggtgctcagccacacctgggcccaggagaggttgtgggaagcataatatctgttttcagatgagctatggcaaagtgcctgccaggttcatgaattcaggctgtggcggccggagcccctccacctccctgtggggcctggccttgagagcctctgcatacgtccgcgtcagcctagggggttccaaatccagcagagtggtaggattccctaagtccctgccaccacaccagaacacacctctgtgctactaggaggaccagacatatccactgctctgggacctgttggacaagagatggtcatctaccacccagccttggctcgctcaaagggtcaccattacacgggtttcaactggttccagcagggtggaccgccaggagccaagcttaacccccatcccctgggatcctgtggagacaggcacctggtgatcagggaagaaccacatacacggcc

SEQ ID NO: 280647 - DNA, 3332 bp, Homo sapiens
tgcaggtgaggtgaagtgaggtcgagggtggtgttgggccggtgctgctgccgctgccgccggggaggaggtggaaagcggggctgtggcgggccggcgggggcggcctgtcagccgctgctttgtctccttagctcgggtcccttctgcgctgccgcagggaggccgcccgggccaggcgagccgaaccaatgctggacctggaggtagtgcccgaacgctctctggggaacgagcaatgggaattcacgctgggaatgcctctggctcaggcagtagccattcttcagaagcactgtcgcatcatcaaaaacgtccaggttctctacagtgaacagtctcctctaagccatgacctcattcttaacctgactcaggacgggatcaaactaatgtttgatgctttcaatcagagacttaaggtgatcgaagtatgtgatttgactaaagtaaagttaaaatattgtggcgtgcattttaattctcaggccatagctcctaccattgaacagattgaccagtcttttggcgcaacccatcctggagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaaggctcccatgatgcctctgagctgtttcctgggcaatgtctatgctgagagtgtagatgttcttcgagatggaactggacctgcaggtttacgacttcgcctacttgctgcaggttgtggacctggcctattagcagatgccaagatgcgggtatttgaacgttcagtgtattttggtgattcctgccaagatgttcttagcatgcttggctctccacacaaagtcttctataaatcagaagacaagatgaaaattcattctccttcccctcataaacaagttccatcgaagtgtaatgactacttttttaactacttcactcttggagtggacatcctctttgatgcgaatacacacaaagtgaagaagtttgttctacacaccaattaccctgggcattataatttcaacatttatcatcgctgtgagttcaagatcccactagccataaagaaagaaaacgcagatggtcagacagaaacatgcacgacctacagcaagtgggacaacatccaggagctcctgggccaccctgtggagaagcctgttgtcctgcacaggtcttcctccccaaacaacaccaacccatttggttccacattctgctttggtcttcagcgaatgatctttgaggtcatgcagaacaaccacattgcctcggtgaccctgtatggcccccccagatattcttctgtccatctttggcctgctggtgccagcaggggacacagactgcaaagagaagcacaaagtttgagccttgattcctggacccaggagctctcaactaacaaggaggcaggagaggtcaacccttgtcccatgcacattgggaagacttggggctctttctgtgactgaggacacaggcacccaggataaggacaaggtcctgcctttggctccacattgccacatgacccttaaggcaagcaggtagcgtgtccatagtacttggttgcgacatttgcactacatccactttagttacttgatgagctggctgtggccagggtggcccacctgcccttccctgttcctttcttgcacgcgctccctgcctgggcacaccaaactggttgaaacacagctttctaccatccaggtacatgcccaggcctggttctcacccctgttggagtcagctttcaagattgcctgtgcccctgctctgccccatcctggctggcagggctgcatgtttccatcctgtttgcctcttttatttaatgccaaagttttagccaaagacatcttcctacttttgttgtgtttcagcattctgttctgcactgtgggctggctctctgccccaaccctgggcactggcccctggctgggccatttcatggctcaaagcctctgggggctcaaggaaggctgggctgctcagtcccttcatgggtcttgctaatggaaagtagcatatatgtgctttaaaaatattaatccttttgaaaagaactgagaagaaaaatgtataattttatcccatttttaatattttggtctagcaacttgtgatacatagatgacaattttgtgagtttttcaaatgtgtgtacagatttttgtaaatatgactcttttgtaattaactcatgtacagcctcatcctgtatagtttaatgatgaatgtgcaggggacctgtctcaggctcctatatggttcctgggccttatagccaggtttgtgtggcgctcccgacttttgtgactgactggtgtcttcccatttggactgtggcctggccagagccccttgcatatccccactgtcaggggcagccaggactgttcccatcctcctggaatgggggaaccttccttatcccctgcccacatcccctctccaataaagcacctgtgccctcagcaatggcctgccatgtgctgttgctgggatgtttgtattaaggtaagtgtgggtattggttttttgagcaagggggtggttgaagcatatggggaaattaatagtggtggcatctcaggggaagacattccttggctcctctgaggggatacagcctccagtgggagactggcattgttgtgtgagttcaggaggtgaggaaagactaggtaggaccgtgcactcatttgtcccttatgtgtggctccatccctggtgctcagccacacctgggcccaggagaggttgtgggaagcataatatctgttttcagatgagctatggcaaagtgcctgccaggttcatgaattcaggctgtggcggccggagcccctccacctccctgtggggcctggccttgagagcctctgcatacgtccgcgtcagcctagggggttccaaatccagcagagtggtaggattccctaagtccctgccaccacaccagaacacacctctgtgctactaggaggaccagacatatccactgctctgggacctgttggacaagagatggtcatctaccacccagccttggctcgctcaaagggtcaccattacacgggtttcaactggttccagcagggtggaccgccaggagccaagcttaacccccatcccctgggatcctgtggagacaggcacctggtgatcagggaagaaccacatacacggcc

SEQ ID NO: 280648 - DNA, 3986 bp, Homo sapiens
tttagtagagtcagagttttaccatgttagctaggctggtttcaaatgcctgacctcaagtgatcctcccaccttggcctccgaaagtgctgggattgcaggcataagccaccacgcccggcccatgcatgatttttgtgatatccaccaccacagataagcaaaagagtccttgcattcaaagagttggacacctgtgcaccgtccaagtattctcttagtgcttgctgcttaacattattgtagctcttactgcttattgaactcttatttactcatgtatctgtagaccttagtagcccccaaacatccccaggctttactgcagggaccagtgcctagtgaagtggtagatgtcaatagatggatagccaaaataaccacataggtgtcttgctttatttcaggaatgcctctggctcaggcagtagccattcttcagaagcactgtcgcatcatcaaaaacgtccaggttctctacagtgaacagtctcctctaagccatgacctcattcttaacctgactcaggacgggatcaaactaatgtttgatgctttcaatcagagacttaaggtgatcgaagtatgtgatttgactaaagtaaagttaaaatattgtggcgtgcattttaattctcaggccatagctcctaccattgaacagattgaccagtcttttggcgcaacccatcctggaggtaagccaagtccatctgattcctctggtcatcagtggcagttcatagcaataaacctgcccggtagtgccatcccaccccacttcctggagtcaggctcccataggattgtggggttggtacttgggtgtgaaggaaacatcctcccccttgttttcaacctagtaggccagtttagaaacaagccacagggaaggtgttgtcagtcattactccctgccaggctggtttatgttagccatttcagatgccagtcaaccatgttattttcttctcccccacccccaacagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaaggctcccatgatgcctctgagctgtttcctgggcaatgtctatgctgagagtgtagatgttcttcgagatggaactggacctgcaggtttacgacttcgcctacttgctgcaggttgtggacctggcctattagcagatgccaagatgcgggtatttgaacgttcagtgtattttggtgattcctgccaagatgttcttagcatgcttggctctccacacaaagtcttctataaatcagaagacaagatgaaaattcattctccttcccctcataaacaagttccatcgaagtgtaatgactacttttttaactacttcactcttggagtggacatcctctttgatgcgaatacacacaaagtgaagaagtttgttctacacaccaattaccctgggcattataatttcaacatttatcatcgctgtgagttcaagatcccactagccataaagaaagaaaacgcagatggtcagacagaaacatgcacgacctacagcaagtgggacaacatccaggagctcctgggccaccctgtggagaagcctgttgtcctgcacaggtcttcctccccaaacaacaccaacccatttggttccacattctgctttggtcttcagcgaatgatctttgaggtcatgcagaacaaccacattgcctcggtgaccctgtatggcccccccaggcctggtagccacctgagaacagcggaactcccctagggacaccaccacccatgcccctctgtcccgtggaactgtgcatcacatcctgctcagtgggcctctgtaccaccctgtgggttttcttggacacctggccagtgctgaagggctgttgtgatgttctgaggttgggctcaggctgggtgctctgccatgggctgagtggcccagatattcttctgtccatctttggcctgctggtgccagcaggggacacagactgcaaagagaagcacaaagtttgagccttgattcctggacccaggagctctcaactaacaaggaggcaggagaggtcaacccttgtcccatgcacattgggaagacttggggctctttctgtgactgaggacacaggcacccaggataaggacaaggtcctgcctttggctccacattgccacatgacccttaaggcaagcaggtagcgtgtccatagtacttggttgcgacatttgcactacatccactttagttacttgatgagctggctgtggccagggtggcccacctgcccttccctgttcctttcttgcacgcgctccctgcctgggcacaccaaactggttgaaacacagctttctaccatccaggtacatgcccaggcctggttctcacccctgttggagtcagctttcaagattgcctgtgcccctgctctgccccatcctggctggcagggctgcatgtttccatcctgtttgcctcttttatttaatgccaaagttttagccaaagacatcttcctacttttgttgtgtttcagcattctgttctgcactgtgggctggctctctgccccaaccctgggcactggcccctggctgggccatttcatggctcaaagcctctgggggctcaaggaaggctgggctgctcagtcccttcatgggtcttgctaatggaaagtagcatatatgtgctttaaaaatattaatccttttgaaaagaactgagaagaaaaatgtataattttatcccatttttaatattttggtctagcaacttgtgatacatagatgacaattttgtgagtttttcaaatgtgtgtacagatttttgtaaatatgactcttttgtaattaactcatgtacagcctcatcctgtatagtttaatgatgaatgtgcaggggacctgtctcaggctcctatatggttcctgggccttatagccaggtttgtgtggcgctcccgacttttgtgactgactggtgtcttcccatttggactgtggcctggccagagccccttgcatatccccactgtcaggggcagccaggactgttcccatcctcctggaatgggggaaccttccttatcccctgcccacatcccctctccaataaagcacctgtgccctcagcaatggcctgccatgtgctgttgctgggatgtttgtattaaggtaagtgtgggtattggttttttgagcaagggggtggttgaagcatatggggaaattaatagtggtggcatctcaggggaagacattccttggctcctctgaggggatacagcctccagtgggagactggcattgttgtgtgagttcaggaggtgaggaaagactaggtaggaccgtgcactcatttgtcccttatgtgtggctccatccctggtgctcagccacacctgggcccaggagaggttgtgggaagcataatatctgttttcagatgagctatggcaaagtgcctgccaggttcatgaattcaggctgtggcggccggagcccctccacctccctgtggggcctggccttgagagcctctgcatacgtccgcgtcagcctagggggttccaaatccagcagagtggtaggattccctaagtccctgccaccacaccagaacacacctctgtgctactaggaggaccagacatatccactgctctgggacctgttggacaagagatggtcatctaccacccagccttggctcgctcaaagggtcaccattacacgggtttcaactggttccagcagggtggaccgccaggagccaagcttaacccccatcccctgggatcctgtggagacaggcacctggtgatcagggaagaaccacatacacggcc

SEQ ID NO: 280649 - DNA, 3533 bp, Homo sapiens
ctttcagtaagtctccttaactggcttccctttccctttttgagggtgtgaagaggacctgattcctggggcaggctcaggcagttttgctgatagaggagtagacaagcaaatgtgtggtaccactggcccctgcaggttctagttgtcttttagttttactggggccttcatacctcagggtctggtggcttctcttctctacccttttcttaagagtcactggtgtcataaagccccagaggatcaactctgtatatcagcctcatgagaactgaccttctcctgacctcattaatgctcttatttaaaagttctctaattaagctttgtattttgatataattagagactcacctgcctgtgtcttaaaaataactctcccagctactatctcacatgatctgtgggcccatcttgtgaagcctagtattaaaaaatatttttgtttttcagtggcgtgcattttaattctcaggccatagctcctaccattgaacagattgaccagtcttttggcgcaacccatcctggagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaaggctcccatgatgcctctgagctgtttcctgggcaatgtctatgctgagagtgtagatgttcttcgagatggaactggacctgcaggtttacgacttcgcctacttgctgcaggttgtggacctggcctattagcagatgccaagatgcgggtatttgaacgttcagtgtattttggtgattcctgccaagatgttcttagcatgcttggctctccacacaaagtcttctataaatcagaagacaagatgaaaattcattctccttcccctcataaacaagttccatcgaagtgtaatgactacttttttaactacttcactcttggagtggacatcctctttgatgcgaatacacacaaagtgaagaagtttgttctacacaccaattaccctgggcattataatttcaacatttatcatcgctgtgagttcaagatcccactagccataaagaaagaaaacgcagatggtcagacagaaacatgcacgacctacagcaagtgggacaacatccaggagctcctgggccaccctgtggagaagcctgttgtcctgcacaggtcttcctccccaaacaacaccaacccatttggttccacattctgctttggtcttcagcgaatgatctttgaggtcatgcagaacaaccacattgcctcggtgaccctgtatggcccccccaggcctggtagccacctgagaacagcggaactcccctagggacaccaccacccatgcccctctgtcccgtggaactgtgcatcacatcctgctcagtgggcctctgtaccaccctgtgggttttcttggacacctggccagtgctgaagggctgttgtgatgttctgaggttgggctcaggctgggtgctctgccatgggctgagtggcccagatattcttctgtccatctttggcctgctggtgccagcaggggacacagactgcaaagagaagcacaaagtttgagccttgattcctggacccaggagctctcaactaacaaggaggcaggagaggtcaacccttgtcccatgcacattgggaagacttggggctctttctgtgactgaggacacaggcacccaggataaggacaaggtcctgcctttggctccacattgccacatgacccttaaggcaagcaggtagcgtgtccatagtacttggttgcgacatttgcactacatccactttagttacttgatgagctggctgtggccagggtggcccacctgcccttccctgttcctttcttgcacgcgctccctgcctgggcacaccaaactggttgaaacacagctttctaccatccaggtacatgcccaggcctggttctcacccctgttggagtcagctttcaagattgcctgtgcccctgctctgccccatcctggctggcagggctgcatgtttccatcctgtttgcctcttttatttaatgccaaagttttagccaaagacatcttcctacttttgttgtgtttcagcattctgttctgcactgtgggctggctctctgccccaaccctgggcactggcccctggctgggccatttcatggctcaaagcctctgggggctcaaggaaggctgggctgctcagtcccttcatgggtcttgctaatggaaagtagcatatatgtgctttaaaaatattaatccttttgaaaagaactgagaagaaaaatgtataattttatcccatttttaatattttggtctagcaacttgtgatacatagatgacaattttgtgagtttttcaaatgtgtgtacagatttttgtaaatatgactcttttgtaattaactcatgtacagcctcatcctgtatagtttaatgatgaatgtgcaggggacctgtctcaggctcctatatggttcctgggccttatagccaggtttgtgtggcgctcccgacttttgtgactgactggtgtcttcccatttggactgtggcctggccagagccccttgcatatccccactgtcaggggcagccaggactgttcccatcctcctggaatgggggaaccttccttatcccctgcccacatcccctctccaataaagcacctgtgccctcagcaatggcctgccatgtgctgttgctgggatgtttgtattaaggtaagtgtgggtattggttttttgagcaagggggtggttgaagcatatggggaaattaatagtggtggcatctcaggggaagacattccttggctcctctgaggggatacagcctccagtgggagactggcattgttgtgtgagttcaggaggtgaggaaagactaggtaggaccgtgcactcatttgtcccttatgtgtggctccatccctggtgctcagccacacctgggcccaggagaggttgtgggaagcataatatctgttttcagatgagctatggcaaagtgcctgccaggttcatgaattcaggctgtggcggccggagcccctccacctccctgtggggcctggccttgagagcctctgcatacgtccgcgtcagcctagggggttccaaatccagcagagtggtaggattccctaagtccctgccaccacaccagaacacacctctgtgctactaggaggaccagacatatccactgctctgggacctgttggacaagagatggtcatctaccacccagccttggctcgctcaaagggtcaccattacacgggtttcaactggttccagcagggtggaccgccaggagccaagcttaacccccatcccctgggatcctgtggagacaggcacctggtgatcagggaagaaccacatacacggcc

SEQ ID NO: 280650 - DNA, 4075 bp, Homo sapiens
tttagtagagtcagagttttaccatgttagctaggctggtttcaaatgcctgacctcaagtgatcctcccaccttggcctccgaaagtgctgggattgcaggcataagccaccacgcccggcccatgcatgatttttgtgatatccaccaccacagataagcaaaagagtccttgcattcaaagagttggacacctgtgcaccgtccaagtattctcttagtgcttgctgcttaacattattgtagctcttactgcttattgaactcttatttactcatgtatctgtagaccttagtagcccccaaacatccccaggctttactgcagggaccagtgcctagtgaagtggtagatgtcaatagatggatagccaaaataaccacataggtgtcttgctttatttcaggaatgcctctggctcaggcagtagccattcttcagaagcactgtcgcatcatcaaaaacgtccaggttctctacagtgaacagtctcctctaagccatgacctcattcttaacctgactcaggacgggatcaaactaatgtttgatgctttcaatcagagacttaaggtgatcgaagtatgtgatttgactaaagtaaagttaaaatattgtggcgtgcattttaattctcaggccatagctcctaccattgaacagattgaccagtcttttggcgcaacccatcctggaggtaagccaagtccatctgattcctctggtcatcagtggcagttcatagcaataaacctgcccggtagtgccatcccaccccacttcctggagtcaggctcccataggattgtggggttggtacttgggtgtgaaggaaacatcctcccccttgttttcaacctagtaggccagtttagaaacaagccacagggaaggtgttgtcagtcattactccctgccaggctggtttatgttagccatttcagatgccagtcaaccatgttattttcttctcccccacccccaacagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaagtaagtataaggagcatgagtttcttgctaaggcctgggctgcctgggagaaagaaccaagcctctgctcattctgtgtctgtccccagggctcccatgatgcctctgagctgtttcctgggcaatgtctatgctgagagtgtagatgttcttcgagatggaactggacctgcaggtttacgacttcgcctacttgctgcaggttgtggacctggcctattagcagatgccaagatgcgggtatttgaacgttcagtgtattttggtgattcctgccaagatgttcttagcatgcttggctctccacacaaagtcttctataaatcagaagacaagatgaaaattcattctccttcccctcataaacaagttccatcgaagtgtaatgactacttttttaactacttcactcttggagtggacatcctctttgatgcgaatacacacaaagtgaagaagtttgttctacacaccaattaccctgggcattataatttcaacatttatcatcgctgtgagttcaagatcccactagccataaagaaagaaaacgcagatggtcagacagaaacatgcacgacctacagcaagtgggacaacatccaggagctcctgggccaccctgtggagaagcctgttgtcctgcacaggtcttcctccccaaacaacaccaacccatttggttccacattctgctttggtcttcagcgaatgatctttgaggtcatgcagaacaaccacattgcctcggtgaccctgtatggcccccccaggcctggtagccacctgagaacagcggaactcccctagggacaccaccacccatgcccctctgtcccgtggaactgtgcatcacatcctgctcagtgggcctctgtaccaccctgtgggttttcttggacacctggccagtgctgaagggctgttgtgatgttctgaggttgggctcaggctgggtgctctgccatgggctgagtggcccagatattcttctgtccatctttggcctgctggtgccagcaggggacacagactgcaaagagaagcacaaagtttgagccttgattcctggacccaggagctctcaactaacaaggaggcaggagaggtcaacccttgtcccatgcacattgggaagacttggggctctttctgtgactgaggacacaggcacccaggataaggacaaggtcctgcctttggctccacattgccacatgacccttaaggcaagcaggtagcgtgtccatagtacttggttgcgacatttgcactacatccactttagttacttgatgagctggctgtggccagggtggcccacctgcccttccctgttcctttcttgcacgcgctccctgcctgggcacaccaaactggttgaaacacagctttctaccatccaggtacatgcccaggcctggttctcacccctgttggagtcagctttcaagattgcctgtgcccctgctctgccccatcctggctggcagggctgcatgtttccatcctgtttgcctcttttatttaatgccaaagttttagccaaagacatcttcctacttttgttgtgtttcagcattctgttctgcactgtgggctggctctctgccccaaccctgggcactggcccctggctgggccatttcatggctcaaagcctctgggggctcaaggaaggctgggctgctcagtcccttcatgggtcttgctaatggaaagtagcatatatgtgctttaaaaatattaatccttttgaaaagaactgagaagaaaaatgtataattttatcccatttttaatattttggtctagcaacttgtgatacatagatgacaattttgtgagtttttcaaatgtgtgtacagatttttgtaaatatgactcttttgtaattaactcatgtacagcctcatcctgtatagtttaatgatgaatgtgcaggggacctgtctcaggctcctatatggttcctgggccttatagccaggtttgtgtggcgctcccgacttttgtgactgactggtgtcttcccatttggactgtggcctggccagagccccttgcatatccccactgtcaggggcagccaggactgttcccatcctcctggaatgggggaaccttccttatcccctgcccacatcccctctccaataaagcacctgtgccctcagcaatggcctgccatgtgctgttgctgggatgtttgtattaaggtaagtgtgggtattggttttttgagcaagggggtggttgaagcatatggggaaattaatagtggtggcatctcaggggaagacattccttggctcctctgaggggatacagcctccagtgggagactggcattgttgtgtgagttcaggaggtgaggaaagactaggtaggaccgtgcactcatttgtcccttatgtgtggctccatccctggtgctcagccacacctgggcccaggagaggttgtgggaagcataatatctgttttcagatgagctatggcaaagtgcctgccaggttcatgaattcaggctgtggcggccggagcccctccacctccctgtggggcctggccttgagagcctctgcatacgtccgcgtcagcctagggggttccaaatccagcagagtggtaggattccctaagtccctgccaccacaccagaacacacctctgtgctactaggaggaccagacatatccactgctctgggacctgttggacaagagatggtcatctaccacccagccttggctcgctcaaagggtcaccattacacgggtttcaactggttccagcagggtggaccgccaggagccaagcttaacccccatcccctgggatcctgtggagacaggcacctggtgatcagggaagaaccacatacacggcc

SEQ ID NO: 280651 - DNA, 2817 bp, Homo sapiens
tgcaggtgaggtgaagtgaggtcgagggtggtgttgggccggtgctgctgccgctgccgccggggaggaggtggaaagcggggctgtggcgggccggcgggggcggcctgtcagccgctgctttgtctccttagctcgggtcccttctgcgctgccgcagggaggccgcccgggccaggcgagccgaaccaatgctggacctggaggtagtgcccgaacgctctctggggaacgagcaatgggaattcacgctgggaatgcctctggctcaggcagtagccattcttcagaagcactgtcgcatcatcaaaaacgtccaggttctctacagtgaacagtctcctctaagccatgacctcattcttaacctgactcaggacgggatcaaactaatgtttgatgctttcaatcagagacttaaggtgatcgaagtatgtgatttgactaaagtaaagttaaaatattgtggcgtgcattttaattctcaggccatagctcctaccattgaacagattgaccagtcttttggcgcaacccatcctggagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaaggctcccatgatgcctctgagctgtttcctgggcaatgtctatgctgagagtgtagatgttcttcgagatggaactggacctgcaggtttacgacttcgcctacttgctgcaggttgtggacctggcctattagcagatgccaagatgcgggtatttgaacgttcagtgtattttggtgattcctgccaagatgttcttagcatgcttggctctccacacaaagtcttctataaatcagaagacaagatgaaaattcattctccttcccctcataaacaagttccatcgaagtgtaatgactacttttttaactacttcactcttggagtggacatcctctttgatgcgaatacacacaaagtgaagaagtttgttctacacaccaattaccctgggcattataatttcaacatttatcatcgctgtgagttcaagatcccactagccataaagaaagaaaacgcagatggtcagacagaaacatgcacgacctacagcaagtgggacaacatccaggagctcctgggccaccctgtggagaagcctgttgtcctgcacaggtcttcctccccaaacaacaccaacccatttggttccacattctgctttggtcttcagcgaatgatctttgaggtcatgcagaacaaccacattgcctcggtgaccctgtatggcccccccaggcctggtagccacctgagaacagcggaactcccctagggacaccaccacccatgcccctctgtcccgtggaactgtgcatcacatcctgctcagtgggcctctgtaccaccctgtgggttttcttggacacctggccagtgctgaagggctgttgtgatgttctgaggttgggctcaggctgggtgcttgctcagtcccttcatgggtcttgctaatggaaagtagcatatatgtgctttaaaaatattaatccttttgaaaagaactgagaagaaaaatgtataattttatcccatttttaatattttggtctagcaacttgtgatacatagatgacaattttgtgagtttttcaaatgtgtgtacagatttttgtaaatatgactcttttgtaattaactcatgtacagcctcatcctgtatagtttaatgatgaatgtgcaggggacctgtctcaggctcctatatggttcctgggccttatagccaggtttgtgtggcgctcccgacttttgtgactgactggtgtcttcccatttggactgtggcctggccagagccccttgcatatccccactgtcaggggcagccaggactgttcccatcctcctggaatgggggaaccttccttatcccctgcccacatcccctctccaataaagcacctgtgccctcagcaatggcctgccatgtgctgttgctgggatgtttgtattaaggtaagtgtgggtattggttttttgagcaagggggtggttgaagcatatggggaaattaatagtggtggcatctcaggggaagacattccttggctcctctgaggggatacagcctccagtgggagactggcattgttgtgtgagttcaggaggtgaggaaagactaggtaggaccgtgcactcatttgtcccttatgtgtggctccatccctggtgctcagccacacctgggcccaggagaggttgtgggaagcataatatctgttttcagatgagctatggcaaagtgcctgccaggttcatgaattcaggctgtggcggccggagcccctccacctccctgtggggcctggccttgagagcctctgcatacgtccgcgtcagcctagggggttccaaatccagcagagtggtaggattccctaagtccctgccaccacaccagaacacacctctgtgctactaggaggaccagacatatccactgctctgggacctgttggacaagagatggtcatctaccacccagccttggctcgctcaaagggtcaccattacacgggtttcaactggttccagcagggtggaccgccaggagccaagcttaacccccatcccctgggatcctgtggagacaggcacctggtgatcagggaagaaccacatacacggcc

SEQ ID NO: 280652 - DNA, 3498 bp, Homo sapiens
ccaccacgtctggccagaaactgcactgtttttgttcacttttgtttcttcaacatctagcacaatgtcctagcccatggtaggcaataaagtagtgaatgaataagtgaatgaagtatccagagcttcatgtcacatgtgggggattgaataagtccctggcattattttgaatagcgatctcttgtacagtcttaagccctggtgacctgatgtttctgattgcatgcagtcttgccccttgccagacctaataatgtagcatgcagccagtagcttctctggggcccccagagagggtctctggtcctaaccataacctgacaacctctctgtcttgttttttgcaggttgtggacctggcctattagcagatgccaagatgcgggtatttgaacgttcagtgtattttggtgattcctgccaagatgttcttagcatgcttggctctccacacaaagtcttctataaatcagaagacaagatgaaaattcattctccttcccctcataaacaagttccatcgaagtgtaatgactacttttttaactacttcactcttggagtggacatcctctttgatgcgaatacacacaaagtgaagaagtttgttctacacaccaattaccctgggcattataatttcaacatgtgagtacacctgtctgtacctcccctctgtgaagtgagttttgggctgaaaaccccaggaaagagcttttggctttgggtgttcactaatttatctacacctgaattcttgctgtttcatgggaagtgaatttcctgagtgcttgctgtgttcctggcacagggtccaatgccttacatctctctgtttgaacccattttacaaatagggaaataagttcagaaagcttgatgtcttatccaaggtaataggctctccagaacccagggccaagatcttttctgttcgacttccgtgcctaaatctggcctcccccagtgaacactgtcaggcactcagagccagggctttgggcaggtgtgtttggttctgtttctcctggggtgtggggttggaatatgggagtggccaggccttctaggaggcccagcctttacccatttgccttctctctagttatcatcgctgtgagttcaagatcccactagccataaagaaagaaaacgcagatggtcagacagaaacatgcacgacctacagcaagtgggacaacatccaggagctcctgggccaccctgtggagaagcctgttgtcctgcacaggtcttcctccccaaacaacaccaacccatttggttccacattctgctttggtcttcagcgaatgatctttgaggtcatgcagaacaaccacattgcctcggtgaccctgtatggcccccccaggcctggtagccacctgagaacagcggaactcccctagggacaccaccacccatgcccctctgtcccgtggaactgtgcatcacatcctgctcagtgggcctctgtaccaccctgtgggttttcttggacacctggccagtgctgaagggctgttgtgatgttctgaggttgggctcaggctgggtgctctgccatgggctgagtggcccagatattcttctgtccatctttggcctgctggtgccagcaggggacacagactgcaaagagaagcacaaagtttgagccttgattcctggacccaggagctctcaactaacaaggaggcaggagaggtcaacccttgtcccatgcacattgggaagacttggggctctttctgtgactgaggacacaggcacccaggataaggacaaggtcctgcctttggctccacattgccacatgacccttaaggcaagcaggtagcgtgtccatagtacttggttgcgacatttgcactacatccactttagttacttgatgagctggctgtggccagggtggcccacctgcccttccctgttcctttcttgcacgcgctccctgcctgggcacaccaaactggttgaaacacagctttctaccatccaggtacatgcccaggcctggttctcacccctgttggagtcagctttcaagattgcctgtgcccctgctctgccccatcctggctggcagggctgcatgtttccatcctgtttgcctcttttatttaatgccaaagttttagccaaagacatcttcctacttttgttgtgtttcagcattctgttctgcactgtgggctggctctctgccccaaccctgggcactggcccctggctgggccatttcatggctcaaagcctctgggggctcaaggaaggctgggctgctcagtcccttcatgggtcttgctaatggaaagtagcatatatgtgctttaaaaatattaatccttttgaaaagaactgagaagaaaaatgtataattttatcccatttttaatattttggtctagcaacttgtgatacatagatgacaattttgtgagtttttcaaatgtgtgtacagatttttgtaaatatgactcttttgtaattaactcatgtacagcctcatcctgtatagtttaatgatgaatgtgcaggggacctgtctcaggctcctatatggttcctgggccttatagccaggtttgtgtggcgctcccgacttttgtgactgactggtgtcttcccatttggactgtggcctggccagagccccttgcatatccccactgtcaggggcagccaggactgttcccatcctcctggaatgggggaaccttccttatcccctgcccacatcccctctccaataaagcacctgtgccctcagcaatggcctgccatgtgctgttgctgggatgtttgtattaaggtaagtgtgggtattggttttttgagcaagggggtggttgaagcatatggggaaattaatagtggtggcatctcaggggaagacattccttggctcctctgaggggatacagcctccagtgggagactggcattgttgtgtgagttcaggaggtgaggaaagactaggtaggaccgtgcactcatttgtcccttatgtgtggctccatccctggtgctcagccacacctgggcccaggagaggttgtgggaagcataatatctgttttcagatgagctatggcaaagtgcctgccaggttcatgaattcaggctgtggcggccggagcccctccacctccctgtggggcctggccttgagagcctctgcatacgtccgcgtcagcctagggggttccaaatccagcagagtggtaggattccctaagtccctgccaccacaccagaacacacctctgtgctactaggaggaccagacatatccactgctctgggacctgttggacaagagatggtcatctaccacccagccttggctcgctcaaagggtcaccattacacgggtttcaactggttccagcagggtggaccgccaggagccaagcttaacccccatcccctgggatcctgtggagacaggcacctggtgatcagggaagaaccacatacacggcc

SEQ ID NO: 280653 - DNA, 3237 bp, Homo sapiens
tttagtagagtcagagttttaccatgttagctaggctggtttcaaatgcctgacctcaagtgatcctcccaccttggcctccgaaagtgctgggattgcaggcataagccaccacgcccggcccatgcatgatttttgtgatatccaccaccacagataagcaaaagagtccttgcattcaaagagttggacacctgtgcaccgtccaagtattctcttagtgcttgctgcttaacattattgtagctcttactgcttattgaactcttatttactcatgtatctgtagaccttagtagcccccaaacatccccaggctttactgcagggaccagtgcctagtgaagtggtagatgtcaatagatggatagccaaaataaccacataggtgtcttgctttatttcaggaatgcctctggctcaggcagtagccattcttcagaagcactgtcgcatcatcaaaaacgtccaggttctctacagtgaacagtctcctctaagccatgacctcattcttaacctgactcaggacgggatcaaactaatgtttgatgctttcaatcagagacttaaggtgatcgaagtatgtgatttgactaaagtaaagttaaaatattgtggcgtgcattttaattctcaggccatagctcctaccattgaacagattgaccagtcttttggcgcaacccatcctggaggtaagccaagtccatctgattcctctggtcatcagtggcagttcatagcaataaacctgcccggtagtgccatcccaccccacttcctggagtcaggctcccataggattgtggggttggtacttgggtgtgaaggaaacatcctcccccttgttttcaacctagtaggccagtttagaaacaagccacagggaaggtgttgtcagtcattactccctgccaggctggtttatgttagccatttcagatgccagtcaaccatgttattttcttctcccccacccccaacagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaagtaagtataaggagcatgagtttcttgctaaggcctgggctgcctgggagaaagaaccaagcctctgctcattctgtgtctgtccccagggctcccatgatgcctctgagctgtttcctgggcaatgtctatgctgagagtgtagatgttcttcgagatggaactggacctgcaggtttacgacttcgcctacttgctgcaggtcagtgactggctttgaggttggtacattccgcattatacccatgttgagacagtctaaaatcccacgtgcttagggtgtgtctcagtccattcaggctgctataataaaataccataaactgagtggctgctaaacaacaaaaatttatttcttgcagttctggaggctgggaagtccaagatcaaggcactggcagattcagtatctggatgcgcctgcagtctagttcatagaagaaacttctccccgtatcctcatatggtgcaaggggctagttaactccctggagtctgttttttaacggcactgatctcaatcctgaggtctctgcttccataatgtaatcacctcccaaagccctgaccttctaataccatcaccttggtggttaggatttcaacatatgaattttaggggaacaaaagcattcagtccattgccacatagttggtagaagacaaatgatgcagatgtttatggttaaagcttttgtttagttttgtcaagggactggacatagtcttataattagcaaatcttaataagcaacagcactgcttctctcagcatgcacataggcctgctgtgtgcttatatagctttgtgacagttcccaagtgtttcctggagatgcatcctgtgggttgcagtgctactgctctccccttttttgtttttttctttttcttttttttgagacagagtcttactctgttgctgaggctggagtgcagtggcacgatctcagcttactgcaccccctgcctcccaggttcaagtgattctcctgcctcagcctcccaagtagctgggattacaggcacgcattagcacacccggctaatttttgtatttttagtagagacagggtttcaccatgttgttcaggctggtctggaactcctgacctcatgatccgcccacctcggcctcccaaagtgctgggattacaggcgtgagccaccgcacctggccagctctccccttttttctacctttttttgttttgttttgttttgttttgtaagagatggcctcattctgtcatccaggctgtagtgcagtggtgcaatcatagctcactgcagcctcaaaactcctgggctcaagtgatctcacctaagcctcccaagtagctaggaccacaggcatgtgctaccatgcccagttaatttttgtctatgtggagatgggtcttgctgtgttacccagaatgatcttgaactcctgggctcaatcgatcctccctccttggctttccaaagtgctggtattacaggtgcaagccgctacacccagcttttctccctatattatccaggccggtgtgcattggaatactgtggccttgaactcctgggctcaagcaatcctgccttaacctcctgactaggctacaggcacgcaccaccatgcctggctctcctttttctaccctttatgccaagttctcaacgtaggcaagcagacgggacttgttgaattgtggtttggccacaccttggccagagttttgccaaccatgaacaacaacaacaaaaagaaatagttggccgggtgcagtggctcatgcctgtaatcccagcaccttgggaggccaaagcgggtggattacctgaggtcaggagttcaagaccagcctgaccaatatgatgaaaccccatctctgctaaaaatacaaaaattagctgggcgtggtaaagcacgcctgtactcccagctactcaggaggctgagacaggagaatcgcttgaactcaggaggcggaggttgcagtgagctgagatagcgccattgcactggagcctgggcaacaagagcgaaactccttctcacagaaaaaaaaaaaa

SEQ ID NO: 280654 - DNA, 1021 bp, Homo sapiens
gaattacgaatgtcgagctccggtaaccaaacgtgggacctcatcctgtatagtttaatgatgaatgtgcaggggacctgtctcaggctcctatatggttcctgggccttatagccaggtttgtgtggcgctcccgacttttgtgactgactggtgtcttcccatttggactgtggcctggccagagccccttgcatatccccactgtcaggggcagccaggactgttcccatcctcctggaatgggggaaccttccttatcccctgcccacatcccctctccaataaagcacctgtgccctcagcaatggcctgccatgtgctgttgctgggatgtttgtattaaggtaagtgtgggtattggttttttgagcaagggggtggttgaagcatatggggaaattaatagtggtggcatctcaggggaagacattccttggctcctctgaggggatacagcctccagtgggagactggcattgttgtgtgagttcaggaggtgaggaaagactaggtaggaccgtgcactcatttgtcccttatgtgtggctccatccctggtgctcagccacacctgggcccaggagaggttgtgggaagcataatatctgttttcagatgagctatggcaaagtgcctgccaggttcatgaattcaggctgtggcggccggagcccctccacctccctgtggggcctggccttgagagcctctgcatacgtccgcgtcagcctagggggttccaaatccagcagagtggtaggattccctaagtccctgccaccacaccagaacacacctctgtgctactaggaggaccagacatatccactgctctgggacctgttggacaagagatggtcatctaccacccagccttggctcgctcaaagggtcaccattacacgggtttcaactggttccagcagggtggaccgccaggagccaagcttaacccccatcccctgggatcctgtggagacaggcacctggtgatcagggaagaaccacatacacggcc

SEQ ID NO: 280655 - DNA, 496 bp, Homo sapiens
cctgccttggcctcccaaagtcctgagtctgcatcctcggattctcttggctctgctgcttaccatctgggcaccacgctaggtgacttactgcacctcctggggccttggtttcctcatctgtaaagaggaacctgccttgaaagtttgtaaagcacctttattcagtaaatctttattgagtacctactgtgtgccaggcactactctaggagttcgggatacagcagtgaagaacacagacggacaaccctgccctcacggagcttatattcagagggaagaaagccacttagcaggacaaagagctaaaatggatagtacagtgtgttgagaggtaacacacatgacagaaaagataaggtatggggccaggcacggtggctcacacctgtaatgccagcactttgggaggccgaggtgggcggatcacctgaggtcaggagtttgagaccaggctggccaacatggtgaaaccccgtctctactaaaaata

SEQ ID NO: 280656 - DNA, 295 bp, Homo sapiens
gggaccagtgcctagtgaagtggtagatgtcaatagatggatagccaaaataaccacataggtgtcttgctttatttcaggaatgcctctggctcaggcagtagccattcttcagaagcactgtcgcatcatcaaaaacgtccaggttctctacagtgaacaggtgagtggtggctgatttgtttattgaaatagcatccctcggtagtgagtcacttccagagctgatgctttgggataggctgactggcaaggatagctgtgttcgaatgggagaatctctagcaccagccag

SEQ ID NO: 280657 - DNA, 3543 bp, Homo sapiens
tgcaggtgaggtgaagtgaggtcgagggtggtgttgggccggtgctgctgccgctgccgccggggaggaggtggaaagcggggctgtggcgggccggcgggggcggcctgtcagccgctgctttgtctccttagctcgggtcccttctgcgctgccgcagggaggccgcccgggccaggcgagccgaaccaatgctggacctggaggtagtgcccgaacgctctctggggaacgagcaatgggaattcacgctgggaatgcctctggctcaggcagtagccattcttcagaagcactgtcgcatcatcaaaaacgtccaggttctctacagtgaacagtctcctctaagccatgacctcattcttaacctgactcaggacgggatcaaactaatgtttgatgctttcaatcagagacttaaggtgatcgaagtatgtgatttgactaaagtaaagttaaaatattgtggcgtgcattttaattctcaggccatagctcctaccattgaacagattgaccagtcttttggcgcaacccatcctggagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaaggctcccatgatgcctctgagctgtttcctgggcaatgtctatgctgagagtgtagatgttcttcgagatggaactggacctgcaggtttacgacttcgcctacttgctgcaggttgtggacctggcctattagcagatgccaagatgcgggtatttgaacgttcagtgtattttggtgattcctgccaagatgttcttagcatgcttggctctccacacaaagtcttctataaatcagaagacaagatgaaaattcattctccttcccctcataaacaagttccatcgaagtgtaatgactacttttttaactacttcactcttggagtggacatcctctttgatgcgaatacacacaaagtgaagaagtttgttctacacaccaattaccctgggcattataatttcaacatttatcatcgctgtgagttcaagatcccactagccataaagaaagaaaacgcagatggtcagacagaaacatgcacgacctacagcaagtgggacaacatccaggagctcctgggccaccctgtggagaagcctgttgtcctgcacaggtcttcctccccaaacaacaccaacccatttggttccacattctgctttggtcttcagcgaatgatctttgaggtcatgcagaacaaccacattgcctcggtgaccctgtatggcccccccaggcctggtagccacctgagaacagcggaactcccctagggacaccaccacccatgcccctctgtcccgtggaactgtgcatcacatcctgctcagtgggcctctgtaccaccctgtgggttttcttggacacctggccagtgctgaagggctgttgtgatgttctgaggttgggctcaggctgggtgctctgccatgggctgagtggcccagatattcttctgtccatctttggcctgctggtgccagcaggggacacagactgcaaagagaagcacaaagtttgagccttgattcctggacccaggagctctcaactaacaaggaggcaggagaggtcaacccttgtcccatgcacattgggaagacttggggctctttctgtgactgaggacacaggcacccaggataaggacaaggtcctgcctttggctccacattgccacatgacccttaaggcaagcaggtagcgtgtccatagtacttggttgcgacatttgcactacatccactttagttacttgatgagctggctgtggccagggtggcccacctgcccttccctgttcctttcttgcacgcgctccctgcctgggcacaccaaactggttgaaacacagctttctaccatccaggtacatgcccaggcctggttctcacccctgttggagtcagctttcaagattgcctgtgcccctgctctgccccatcctggctggcagggctgcatgtttccatcctgtttgcctcttttatttaatgccaaagttttagccaaagacatcttcctacttttgttgtgtttcagcattctgttctgcactgtgggctggctctctgccccaaccctgggcactggcccctggctgggccatttcatggctcaaagcctctgggggctcaaggaaggctgggctgctcagtcccttcatgggtcttgctaatggaaagtagcatatatgtgctttaaaaatattaatccttttgaaaagaactgagaagaaaaatgtataattttatcccatttttaatattttggtctagcaacttgtgatacatagatgacaattttgtgagtttttcaaatgtgtgtacagatttttgtaaatatgactcttttgtaattaactcatgtacagcctcatcctgtatagtttaatgatgaatgtgcaggggacctgtctcaggctcctatatggttcctgggccttatagccaggtttgtgtggcgctcccgacttttgtgactgactggtgtcttcccatttggactgtggcctggccagagccccttgcatatccccactgtcaggggcagccaggactgttcccatcctcctggaatgggggaaccttccttatcccctgcccacatcccctctccaataaagcacctgtgccctcagcaatggcctgccatgtgctgttgctgggatgtttgtattaaggtaagtgtgggtattggttttttgagcaagggggtggttgaagcatatggggaaattaatagtggtggcatctcaggggaagacattccttggctcctctgaggggatacagcctccagtgggagactggcattgttgtgtgagttcaggaggtgaggaaagactaggtaggaccgtgcactcatttgtcccttatgtgtggctccatccctggtgctcagccacacctgggcccaggagaggttgtgggaagcataatatctgttttcagatgagctatggcaaagtgcctgccaggttcatgaattcaggctgtggcggccggagcccctccacctccctgtggggcctggccttgagagcctctgcatacgtccgcgtcagcctagggggttccaaatccagcagagtggtaggattccctaagtccctgccaccacaccagaacacacctctgtgctactaggaggaccagacatatccactgctctgggacctgttggacaagagatggtcatctaccacccagccttggctcgctcaaagggtcaccattacacgggtttcaactggttccagcagggtggaccgccaggagccaagcttaacccccatcccctgggatcctgtggagacaggcacctggtgatcagggaagaaccacatacacggcc

SEQ ID NO: 280658 - DNA, 2858 bp, Homo sapiens
tgcaggtgaggtgaagtgaggtcgagggtggtgttgggccggtgctgctgccgctgccgccggggaggaggtggaaagcggggctgtggcgggccggcgggggcggcctgtcagccgctgctttgtctccttagctcgggtcccttctgcgctgccgcagggaggccgcccgggccaggcgagccgaaccaatgctggacctggaggtagtgcccgaacgctctctggggaacgagcaatgggaattcacgctgggaatgcctctggctcaggcagtagccattcttcagaagcactgtcgcatcatcaaaaacgtccaggttctctacagtgaacagtctcctctaagccatgacctcattcttaacctgactcaggacgggatcaaactaatgtttgatgctttcaatcagagacttaaggtgatcgaagtatgtgatttgactaaagtaaagttaaaatattgtggcgtgcattttaattctcaggccatagctcctaccattgaacagattgaccagtcttttggcgcaacccatcctggagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaaggctcccatgatgcctctgagctgtttcctgggcaatgtctatgctgagagtgtagatgttcttcgagatggaactggacctgcaggtttacgacttcgcctacttgctgcaggttgtggacctggcctattagcagatgccaagatgcgggtatttgaacgttcagtgtattttggtgattcctgccaagatgttcttagcatgcttggctctccacacaaagtcttctataaatcagaagacaagatgaaaattcattctccttcccctcataaacaagttccatcgaagtgtaatgactacttttttaactacttcactcttggagtggacatcctctttgatgcgaatacacacaaagtgaagaagtttgttctacacaccaattaccctgggcattataatttcaacatttatcatcgctgtgagttcaagatcccactagccataaagaaagaaaacgcagatggtcagacagaaacatgcacgacctacagcaagtgggacaacatccaggagctcctgggccaccctgtggagaagcctgttgtcctgcacaggtcttcctccccaaacaacaccaacccatttggttccacattctgctttggtcttcagcgaatgatctttgaggtcatgcagaacaaccacattgcctcggtgaccctgtatggcccccccaggcctggtagccacctgagaacagcggaactcccctagggacaccaccacccatgcccctctgtcccgtggaactgtgcatcacatcctgctcagtgggcctctgtaccaccctgtgggttttcttggacacctggccagtgctgaagggctgttgtgatgttctgaggttgggctcaggctgggtgctctgccatgggctgagtggcccagatattcttctgtccatctttggcctgctggtgccagcaggggacacagactgcaaagagaagcacaaagtttgagccttgattcctggacccaggagctctcaactaacaaggaggcaggagaggtcaacccttgtcccatgcacattgggaagacttggggctctttctgtgactgaggacacaggcacccaggataaggacaaggtcctgcctttggctccacattgccacatgacccttaaggcaagcaggtagcgtgtccatagtacttggttgcgacatttgcactacatccactttagttacttgatgagctggctgtggccagggtggcccacctgcccttccctgttcctttcttgcacgcgctccctgcctgggcacaccaaactggttgaaacacagctttctaccatccaggtacatgcccaggcctggttctcacccctgttggagtcagctttcaagattgcctgtgcccctgctctgccccatcctggctggcagggctgcatgtttccatcctgtttgcctcttttatttaatgccaaagttttagccaaagacatcttcctacttttgttgtgtttcagcattctgttctgcactgtgggctggctctctgccccaaccctgggcactggcccctggctgggccatttcatggctcaaagcctctgggggctcaaggaaggctgggctgctcagtcccttcatgggtcttgctaatggaaagtagcatatatgtgctttaaaaatattaatccttttgaaaagaactgagaagaaaaatgtataattttatcccatttttaatattttggtctagcaacttgtgatacatagatgacaattttgtgagtttttcaaatgtgtgtacagatttttgtaaatatgactcttttgtaattaactcatgtacagcctcatcctgtatagtttaatgatgaatgtgcaggggacctgtctcaggctcctatatggttcctgggccttatagccaggtttgtgtggcgctcccgacttttgtgactgactggtgtcttcccatttggactgtggcctggccagagccccttgcatatccccactgtcaggggcagccaggactgttcccatcctcctggaatgggggaaccttccttatcccctgcccacatcccctctccaataaagcacctggcaggccattgctgagggcacaggtgctttattggagagc

SEQ ID NO: 280659 - DNA, 1111 bp, Homo sapiens
tgcaggtgaggtgaagtgaggtcgagggtggtgttgggccggtgctgctgccgctgccgccggggaggaggtggaaagcggggctgtggcgggccggcgggggcggcctgtcagccgctgctttgtctccttagctcgggtcccttctgcgctgccgcagggaggccgcccgggccaggcgagccgaaccaatgctggacctggaggtagtgcccgaacgctctctggggaacgagcaatgggaattcacgctgggaatgcctctggctcaggcagtagccattcttcagaagcactgtcgcatcatcaaaaacgtccaggttctctacagtgaacagtctcctctaagccatgacctcattcttaacctgactcaggacgggatcaaactaatgtttgatgctttcaatcagagacttaaggtgatcgaagtatgtgatttgactaaagtaaagttaaaatattgtggcgtgcattttaattctcaggccatagctcctaccattgaacagattgaccagtcttttggcgcaacccatcctggagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaaggctcccatgatgcctctgagctgtttcctgggcaatgtctatgctgagagtgtagatgttcttcgagatggaactggacctgcaggtttacgacttcgcctacttgctgcaggttgtggacctggcctattagcagatgccaagatgcgggtatttgaacgttcagtgtattttggtgattcctgccaagatgttcttagcatgcttggctctccacacaaagtcttctataaatcagaagacaagatgaaaattcattctccttcccctcataaacaagttccatcgaagtgtaatgactacttttttaactacttcactcttggagtggcactactctaggagttcgggatacagcagtgaagaacaca

SEQ ID NO: 280660 - DNA, 1642 bp, Homo sapiens
tgcaggtgaggtgaagtgaggtcgagggtggtgttgggccggtgctgctgccgctgccgccggggaggaggtggaaagcggggctgtggcgggccggcgggggcggcctgtcagccgctgctttgtctccttagctcgggtcccttctgcgctgccgcagggaggccgcccgggccaggcgagccgaaccaatgctggacctggaggtagtgcccgaacgctctctggggaacgagcaatgggaattcacgctgggaatgcctctggctcaggcagtagccattcttcagaagcactgtcgcatcatcaaaaacgtccaggttctctacagtgaacagtctcctctaagccatgacctcattcttaacctgactcaggacgggatcaaactaatgtttgatgctttcaatcagagacttaaggtgatcgaagtatgtgatttgactaaagtaaagttaaaatattgtggcgtgcattttaattctcaggccatagctcctaccattgaacagattgaccagtcttttggcgcaacccatcctggagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaaggctcccatgatgcctctgagctgtttcctgggcaatgtctatgctgagagtgtagatgttcttcgagatggaactggacctgcaggtttacgacttcgcctacttgctgcaggtcagtgactggctttgaggttggtacattccgcattatacccatgttgagacagtctaaaatcccacgtgcttagggtgtgtctcagtccattcaggctgctataataaaataccataaactgagtggctgctaaacaacaaaaatttatttcttgcagttctggaggctgggaagtccaagatcaaggcactggcagattcagtatctggatgcgcctgcagtctagttcatagaagaaacttctccccgtatcctcatatggtgcaaggggctagttaactccctggagtctgttttttaacggcactgatctcaatcctgaggtctctgcttccataatgtaatcacctcccaaagccctgaccttctaataccatcaccttggtggttaggatttcaacatatgaattttaggggaacaaaagcattcagtccattgccacatagttggtagaagacaaatgatgcagatgtttatggttaaagcttttgtttagttttgtcaagggactggacatagtcttataattagcaaatcttaataagcaacagcactgcttctctcagcatgcacataggcctgctgtgtgcttatatagctttgtgacagttcccaagtgtttcctggagatgcatcctgtgggttgcagtgctactgctctccccttttttgtttttttctttttcttttttttgagacagagtcttactctgttgctgagatagcgccattgcactggagcctgggcaacaagagcgaaactccttctcacagaaaaaaaaaaaa

SEQ ID NO: 280661 - DNA, 865 bp, Homo sapiens
gcgcagtgttctagaggatccctatccccgaaaataactgccaagtgcaagagggacaatcttcagaataaataatattctgaaggactgacaaaacagagatatagacaaagggaaacaccggtgtttccctttcttgcagtgtcttgccacccagtgaatatatggcatctttcccgggcacagacaccagggtgtgctggagccggtcccgaggcaaaggagcacaccactcccagtcaacggtggcattgttgcacttccacatgcgccgtgggatggaccctcccaccacatacaagtctccaccatgcttgcaggccgcagtgatctggtggcacaaactgttttggccacttacactgatggagtcatcttctgcacagtgcaaggacacagccaacgagtgggtacgagatgactctttcccaatcaggtaaatgtgcacattctccccaatttcctattggcaaaattaaaattatatgacagctgttaaattctaggctaaggctcagctaagacacatatccttaagatcctggccctcacacttgttcctagctttatcatactactctctaattactgtatggcatccaactctcctctagtcactttctttgaggcaatttatgccgggcggagaatctgttgtattcatccttgtagcttttaaaaaactctcataagctagtgcttcagacaaagggtgattaagattgttaacttgatgacagtagttctcaaggaactttgaaagctcatagattggtggtactggggttacaaagacatccttctccccagctcatatcaacttcaagccagagataacttattcaaaaataaataaataaataca

SEQ ID NO: 280662 - DNA, 2741 bp, Homo sapiens
cctccgaggccgccgggccctcctccagagtcccgccagtcccccagagtccaggccagtccccgccgtcacccggtgcgaacccgcgagaggcctagtgcagctggcagccccgccccggcacccgcctgctcttctcgcgggtccggaccgcgagcgcgggggccgacgggtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccaggtgagccgggccggggagcccgggcccctgccccgtccccgccgctccgtccctgtcgggccgctggggtctccaccgtctttgctgagccacctctttgcctcggcagctggtacaggacgagaacgtgcgcggggtgatcaccatgaacgaggagtacgagacgaggttcctgtgcaactcttcacaggagtggaagagactaggagtcgagcagctgcggctcagcacagtagacatgactgggatccccaccttggacaacctccagaagggagtccaatttgctctcaagtaccagtcgctgggccagtgtgtttacgtgcattgtaaggctgggcgctccaggagtgccactatggtggcagcatacctgattcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacaccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataatcatttctattttctggcttaccccttggaataagccaaaaataaaaccaaagttacatttcctgacagatggctaagaaaacaatagaaggaacatcctgaattctagagttgactcttgctggtgaagtacaccttcagcttagtccattctcctaagtaaagcctgaaggaaaactcttaacacctaattctttgtggaaaaatgatcaactagccatttcacaggctatagaacaaaagtacaattgggcatctttccttatgtcctgggatcaggggtgcttacatttaacattgatcaggtaaagaggagaggctgtgcctaaggtctgagaaaaggcttgctctaagcaagctgtggtgaggcacaggatgactagggaatggcagagaacaggctggcctactgtcagttcaagcaaccagctgagcagcagcagtctaaaaagccccaaacagaacacctccatggattcagggaagggctgaggcactgcctttctagtatgtgccaaaaaaaacataactctgaattggggcccaggggactttgagtttgtatggggagggaaaaggagtgagcagttctcctcccctccccacagccttaggccaacacaaactgcaaattggtaagcagcaccttaatacctcttgtgacagttacggctgaagtggcagggtcaagcttgtaggtgttggcatccccctttttatatcggtcccggaagacatagatgctcccgttacagctggcaatcttccagagggatggggcagagctccaggcctcaggaaggcaaagccgggtgaagctgtctagcaagggattgtagcacaccagggagtccccttcagccacgatgaacaccagatctttatgcacagctgcgtgcatgcggcctgcaaagggcagcacatagggcttcacatggcatttgtctgtctctgtgtcaaagcactggatgagtcgggaaggtttggtaaagaagtccagatcattctcctccccccctagtaagtagatgatcccgttgaggttggcaccagcagcccctgacacagccacctctagctgagttgtctctgtccacacattatcacctacgcgataataaatgactgcgttggagagggta

SEQ ID NO: 280663 - DNA, 2632 bp, Homo sapiens
cctccgaggccgccgggccctcctccagagtcccgccagtcccccagagtccaggccagtccccgccgtcacccggtgcgaacccgcgagaggcctagtgcagctggcagccccgccccggcacccgcctgctcttctcgcgggtccggaccgcgagcgcgggggccgacgggtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccagctggtacaggacgagaacgtgcgcggggtgatcaccatgaacgaggagtacgagacgaggttcctgtgcaactcttcacaggagtggaagagactaggagtcgagcagctgcggctcagcacagtagacatgactgggatccccaccttggacaacctccagaagggagtccaatttgctctcaagtaccagtcgctgggccagtgtgtttacgtgcattgtaaggctgggcgctccaggagtgccactatggtggcagcatacctgattcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacaccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataatcatttctattttctggcttaccccttggaataagccaaaaataaaaccaaagttacatttcctgacagatggctaagaaaacaatagaaggaacatcctgaattctagagttgactcttgctggtgaagtacaccttcagcttagtccattctcctaagtaaagcctgaaggaaaactcttaacacctaattctttgtggaaaaatgatcaactagccatttcacaggctatagaacaaaagtacaattgggcatctttccttatgtcctgggatcaggggtgcttacatttaacattgatcaggtaaagaggagaggctgtgcctaaggtctgagaaaaggcttgctctaagcaagctgtggtgaggcacaggatgactagggaatggcagagaacaggctggcctactgtcagttcaagcaaccagctgagcagcagcagtctaaaaagccccaaacagaacacctccatggattcagggaagggctgaggcactgcctttctagtatgtgccaaaaaaaacataactctgaattggggcccaggggactttgagtttgtatggggagggaaaaggagtgagcagttctcctcccctccccacagccttaggccaacacaaactgcaaattggtaagcagcaccttaatacctcttgtgacagttacggctgaagtggcagggtcaagcttgtaggtgttggcatccccctttttatatcggtcccggaagacatagatgctcccgttacagctggcaatcttccagagggatggggcagagctccaggcctcaggaaggcaaagccgggtgaagctgtctagcaagggattgtagcacaccagggagtccccttcagccacgatgaacaccagatctttatgcacagctgcgtgcatgcggcctgcaaagggcagcacatagggcttcacatggcatttgtctgtctctgtgtcaaagcactggatgagtcgggaaggtttggtaaagaagtccagatcattctcctccccccctagtaagtagatgatcccgttgaggttggcaccagcagcccctgacacagccacctctagctgagttgtctctgtccacacattatcacctacgcgataataaatgactgcgttggagagggta

SEQ ID NO: 280664 - DNA, 3363 bp, Homo sapiens
cctccgaggccgccgggccctcctccagagtcccgccagtcccccagagtccaggccagtccccgccgtcacccggtgcgaacccgcgagaggcctagtgcagctggcagccccgccccggcacccgcctgctcttctcgcgggtccggaccgcgagcgcgggggccgacgggtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccagctggtacaggacgagaacgtgcgcggggtgatcaccatgaacgaggagtacgagacgaggttcctgtgcaactcttcacaggagtggaagagactaggagtcgagcagctgcggctcagcacagtagacatgactgggatccccaccttggacaacctccagaagggagtccaatttgctctcaagtaccagtcgctgggccagtgtgtttacgtgcattgtaaggctgggcgctccaggagtgccactatggtggcagcatacctgattcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacaccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataatcatttctattttctggcttaccccttggaataagccaaaaataaaaccaaagttacatttcctgacagatggctaagaaaacaatagaaggaacatcctgaattctagagttgactcttgctggtgaagtacaccttcagcttagtccattctcctaagtaaagcctgaaggaaaactcttaacacctaattctttgtggaaaaatgatcaactagccatttcacaggctatagaacaaaagtacaattgggcatctttccttatgtcctgggatcaggggtgcttacatttaacattgatcaggtaaagaggagaggctgtgcctaaggtctgagaaaaggcttgctctaagcaagctgtggtgaggcacaggatgactagggaatggcagagaacaggctggcctactgtcagttcaagcaaccagctgagcagcagcagtctaaaaagccccaaacagaacacctccatggattcagggaagggctgaggcactgcctttctagtatgtgccaaaaaaaacataactctgaattggggcccaggggactttgagtttgtatggggagggaaaaggagtgagcagttctcctcccctccccacagccttaggccaacacaaactgcaaattggtaagcagcaccttaatacctcttgtgacagttacggctgaagtggcagggtcaagcttgtaggtgttggcatccccctttttatatcggtcccggaagacatagatgctcccgttacagctggcaatcttccagagggatggggcagagctccaggcctcaggaaggcaaagccgggtgaagctgtctagcaagggattgtagcacaccagggagtccccttcagccacgatgaacaccagatctttatgcacagctgcgtgcatgcggcctgcaaagggcagcacatagggcttcacatggcatttgtctgtctctgtgtcaaagcactggatgagtcgggaaggtttggtaaagaagtccagatcattctcctccccccctagtaagtagatgatcccgttgaggttggcaccagcagcccctgacacagccacctctagctgagttgtctctgtccacacattatcacctacgcgataataaatgactgcgttggagagggtatcttgcagtgtcttgccacccagtgaatatatggcatctttcccgggcacagacaccagggtgtgctggagccggtcccgaggcaaaggagcacaccactcccagtcaacggtggcattgttgcacttccacatgcgccgtgggatggaccctcccaccacatacaagtctccaccatgcttgcaggccgcagtgatctggtggcacaaactgttttggccacttacactgatggagtcatcttctgcacagtgcaaggacacagccaacgagtgggtacgagatgactctttcccaatcaggtaaatgtgcacattctccccaatttcctattggcaaaattaaaattatatgacagctgttaaattctaggctaaggctcagctaagacacatatccttaagatcctggccctcacacttgttcctagctttatcatactactctctaattactgtatggcatccaactctcctctagtcactttctttgaggcaatttatgccgggcggagaatctgttgtattcatccttgtagcttttaaaaaactctcataagctagtgcttcagacaaagggtgattaagattgttaacttgatgacagtagttctcaaggaactttgaaagctcatagattggtggtactggggttacaaagacatccttctccccagctcatatcaacttcaagccagagataacttattcaaaaataaataaataaataca

SEQ ID NO: 280665 - DNA, 2440 bp, Homo sapiens
cctccgaggccgccgggccctcctccagagtcccgccagtcccccagagtccaggccagtccccgccgtcacccggtgcgaacccgcgagaggcctagtgcagctggcagccccgccccggcacccgcctgctcttctcgcgggtccggaccgcgagcgcgggggccgacgggtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccagctggtacaggacgagaacgtgcgcggggtgatcaccatgaacgaggagtacgagacgaggttcctgtgcaactcttcacaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacaccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataatcatttctattttctggcttaccccttggaataagccaaaaataaaaccaaagttacatttcctgacagatggctaagaaaacaatagaaggaacatcctgaattctagagttgactcttgctggtgaagtacaccttcagcttagtccattctcctaagtaaagcctgaaggaaaactcttaacacctaattctttgtggaaaaatgatcaactagccatttcacaggctatagaacaaaagtacaattgggcatctttccttatgtcctgggatcaggggtgcttacatttaacattgatcaggtaaagaggagaggctgtgcctaaggtctgagaaaaggcttgctctaagcaagctgtggtgaggcacaggatgactagggaatggcagagaacaggctggcctactgtcagttcaagcaaccagctgagcagcagcagtctaaaaagccccaaacagaacacctccatggattcagggaagggctgaggcactgcctttctagtatgtgccaaaaaaaacataactctgaattggggcccaggggactttgagtttgtatggggagggaaaaggagtgagcagttctcctcccctccccacagccttaggccaacacaaactgcaaattggtaagcagcaccttaatacctcttgtgacagttacggctgaagtggcagggtcaagcttgtaggtgttggcatccccctttttatatcggtcccggaagacatagatgctcccgttacagctggcaatcttccagagggatggggcagagctccaggcctcaggaaggcaaagccgggtgaagctgtctagcaagggattgtagcacaccagggagtccccttcagccacgatgaacaccagatctttatgcacagctgcgtgcatgcggcctgcaaagggcagcacatagggcttcacatggcatttgtctgtctctgtgtcaaagcactggatgagtcgggaaggtttggtaaagaagtccagatcattctcctccccccctagtaagtagatgatcccgttgaggttggcaccagcagcccctgacacagccacctctagctgagttgtctctgtccacacattatcacctacgcgataataaatgactgcgttggagagggta

SEQ ID NO: 280666 - DNA, 2149 bp, Homo sapiens
tcccatttataatacaagcagcatgatttttaatgcctgcaaaatagagtttccaaagaaatgaaatctcagagtcctttagcacctgctcatgggtcaagggcaccttgacacctgcttctttctttctctgctgatttcccaaccctgtacttcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacaccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataatcatttctattttctggcttaccccttggaataagccaaaaataaaaccaaagttacatttcctgacagatggctaagaaaacaatagaaggaacatcctgaattctagagttgactcttgctggtgaagtacaccttcagcttagtccattctcctaagtaaagcctgaaggaaaactcttaacacctaattctttgtggaaaaatgatcaactagccatttcacaggctatagaacaaaagtacaattgggcatctttccttatgtcctgggatcaggggtgcttacatttaacattgatcaggtaaagaggagaggctgtgcctaaggtctgagaaaaggcttgctctaagcaagctgtggtgaggcacaggatgactagggaatggcagagaacaggctggcctactgtcagttcaagcaaccagctgagcagcagcagtctaaaaagccccaaacagaacacctccatggattcagggaagggctgaggcactgcctttctagtatgtgccaaaaaaaacataactctgaattggggcccaggggactttgagtttgtatggggagggaaaaggagtgagcagttctcctcccctccccacagccttaggccaacacaaactgcaaattggtaagcagcaccttaatacctcttgtgacagttacggctgaagtggcagggtcaagcttgtaggtgttggcatccccctttttatatcggtcccggaagacatagatgctcccgttacagctggcaatcttccagagggatggggcagagctccaggcctcaggaaggcaaagccgggtgaagctgtctagcaagggattgtagcacaccagggagtccccttcagccacgatgaacaccagatctttatgcacagctgcgtgcatgcggcctgcaaagggcagcacatagggcttcacatggcatttgtctgtctctgtgtcaaagcactggatgagtcgggaaggtttggtaaagaagtccagatcattctcctccccccctagtaagtagatgatcccgttgaggttggcaccagcagcccctgacacagccacctctagctgagttgtctctgtccacacattatcacctacgcgataataaatgactgcgttggagagggta

SEQ ID NO: 280667 - DNA, 1868 bp, Homo sapiens
tcgaattcaagcttctaacgatgtacggggacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacaccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataatcatttctattttctggcttaccccttggaataagccaaaaataaaaccaaagttacatttcctgacagatggctaagaaaacaatagaaggaacatcctgaattctagagttgactcttgctggtgaagtacaccttcagcttagtccattctcctaagtaaagcctgaaggaaaactcttaacacctaattctttgtggaaaaatgatcaactagccatttcacaggctatagaacaaaagtacaattgggcatctttccttatgtcctgggatcaggggtgcttacatttaacattgatcaggtaaagaggagaggctgtgcctaaggtctgagaaaaggcttgctctaagcaagctgtggtgaggcacaggatgactagggaatggcagagaacaggctggcctactgtcagttcaagcaaccagctgagcagcagcagtctaaaaagccccaaacagaacacctccatggattcagggaagggctgaggcactgcctttctagtatgtgccaaaaaaaacataactctgaattggggcccaggggactttgagtttgtatggggagggaaaaggagtgagcagttctcctcccctccccacagccttaggccaacacaaactgcaaattggtaagcagcaccttaatacctcttgtgacagttacggctgaagtggcagggtcaagcttgtaggtgttggcatccccctttttatatcggtcccggaagacatagatgctcccgttacagctggcaatcttccagagggatggggcagagctccaggcctcaggaaggcaaagccgggtgaagctgtctagcaagggattgtagcacaccagggagtccccttcagccacgatgaacaccagatctttatgcacagctgcgtgcatgcggcctgcaaagggcagcacatagggcttcacatggcatttgtctgtctctgtgtcaaagcactggatgagtcgggaaggtttggtaaagaagtccagatcattctcctccccccctagtaagtagatgatcccgttgaggttggcaccagcagcccctgacacagccacctctagctgagttgtctctgtccacacattatcacctacgcgataataaatgactgcgttggagagggta

SEQ ID NO: 280668 - DNA, 2536 bp, Homo sapiens
cctccgaggccgccgggccctcctccagagtcccgccagtcccccagagtccaggccagtccccgccgtcacccggtgcgaacccgcgagaggcctagtgcagctggcagccccgccccggcacccgcctgctcttctcgcgggtccggaccgcgagcgcgggggccgacgggtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccagctggtacaggacgagaacgtgcgcggggtgatcaccatgaacgaggagtacgagacgaggttcctgtgcaactcttcacaggagtggaagagactaggagtcgagcagctgcggctcagcacagtagacatgactgggatccccaccttggacaacctccagaagggagtccaatttgctctcaagtaccagtcgctgggccagtgtgtttacgtgcattgtaaggctgggcgctccaggagtgccactatggtggcagcatacctgattcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacaccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataatcatttctattttctggcttaccccttggaataagccaaaaataaaaccaaagttacatttcctgacagatggctaagaaaacaatagaaggaacatcctgaattctagagttgactcttgctggtgaagtacaccttcagcttagtccattctcctaagtaaagcctgaaggaaaactcttaacacctaattctttgtggaaaaatgatcaactagccatttcacaggctatagaacaaaagtacaattgggcatctttccttatgtcctgggatcaggggtgcttacatttaacattgatcaggtaaagaggagaggctgtgcctaaggtctgagaaaaggcttgctctaagcaagctgtggtgaggcacaggatgactagggaatggcagagaacaggctggcctactgtcagttcaagcaaccagctgagcagcagcagtctaaaaagccccaaacagaacacctccatggattcagggaagggctgaggcactgcctttctagtatgtgccaaaaaaaacataactctgaattggtaagcagcaccttaatacctcttgtgacagttacggctgaagtggcagggtcaagcttgtaggtgttggcatccccctttttatatcggtcccggaagacatagatgctcccgttacagctggcaatcttccagagggatggggcagagctccaggcctcaggaaggcaaagccgggtgaagctgtctagcaagggattgtagcacaccagggagtccccttcagccacgatgaacaccagatctttatgcacagctgcgtgcatgcggcctgcaaagggcagcacatagggcttcacatggcatttgtctgtctctgtgtcaaagcactggatgagtcgggaaggtttggtaaagaagtccagatcattctcctccccccctagtaagtagatgatcccgttgaggttggcaccagcagcccctgacacagccacctctagctgagttgtctctgtccacacattatcacctacgcgataataaatgactgcgttggagagggta

SEQ ID NO: 280669 - DNA, 3013 bp, Homo sapiens
cctccgaggccgccgggccctcctccagagtcccgccagtcccccagagtccaggccagtccccgccgtcacccggtgcgaacccgcgagaggcctagtgcagctggcagccccgccccggcacccgcctgctcttctcgcgggtccggaccgcgagcgcgggggccgacgggtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccagctggtacaggacgagaacgtgcgcggggtgatcaccatgaacgaggagtacgagacgaggttcctgtgcaactcttcacaggagtggaagagactaggagtcgagcagctgcggctcagcacagtagacatgactgggatccccaccttggacaacctccagaagggagtccaatttgctctcaagtaccagtcgctgggccagtgtgtttacgtgcattgtaaggctgggcgctccaggagtgccactatggtggcagcatacctgattcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacaccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataatcatttctattttctggcttaccccttggaataagccaaaaataaaaccaaagttacatttcctgacagatggctaagaaaacaatagaaggaacatcctgaattctagagttgactcttgctggtgaagtacaccttcagcttagtccattctcctaagtaaagcctgaaggaaaactcttaacacctaattctttgtggaaaaatgatcaactagccatttcacaggctatagaacaaaagtacaattgggcatctttccttatgtcctgggatcaggggtgcttacatttaacattgatcaggtaaagaggagaggctgtgcctaaggtctgagaaaaggcttgctctaagcaagctgtggtgaggcacaggatgactagggaatggcagagaacaggctggcctactgtcagttcaagcaaccagctgagcagcagcagtctaaaaagccccaaacagaacacctccatggattcagggaagggctgaggcactgcctttctagtatgtgccaaaaaaaacataactctgaattggggcccaggggactttgagtttgtatggggagggaaaaggagtgagcagttctcctcccctccccacagccttaggccaacacaaactgcaaattggtaagcagcaccttaatacctcttgtgacagttacggctgaagtggcagggtcaagcttgtaggtgttggcatccccctttttatatcggtcccggaagacatagatgctcccgttacagctggcaatcttccagagggatggggcagagctccaggcctcaggaaggcaaagccgggtgaagctgtctagcaagggattgtagcacaccagggagtccccttcagccacgatgaacaccagatctttatgcacagctgcgtgcatgcggcctgcaaagggcagcacatagggcttcacatggcatttgtctgtctctgtgtcaaagcactggatgagtcgggaaggtttggtaaagaagtccagatcattctcctccccccctagtaagtagatgatcccgttgaggttggcaccagcagcccctgacacagccacctctagctgagttgtctctgtccacacattatcacctacgcgataataaatgactgcgttggagagggtatcttgcagtgtcttgccacccagtgaatatatggcatctttcccgggcacagacaccagggtgtgctggagccggtcccgaggcaaaggagcacaccactcccagtcaacggtggcattgttgcacttccacatgcgccgtgggatggaccctcccaccacatacaagtctccaccatgcttgcaggccgcagtgatctggtggcacaaactgttttggccacttacactgatggagtcatcttctgcacagtgcaaggacacagccaacgagtgggtacgagatgactctttcccaatcaggtaaatgtgcacattctccccaatttccttcaagcttgtcctgagtgactctgcaaaagcctctctttcctctttatta

SEQ ID NO: 280670 - DNA, 2549 bp, Homo sapiens
cctccgaggccgccgggccctcctccagagtcccgccagtcccccagagtccaggccagtccccgccgtcacccggtgcgaacccgcgagaggcctagtgcagctggcagccccgccccggcacccgcctgctcttctcgcgggtccggaccgcgagcgcgggggccgacgggtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccaggtgagccgggccggggagcccgggcccctgccccgtccccgccgctccgtccctgtcgggccgctggggtctccaccgtctttgctgagccacctctttgcctcggcagctggtacaggacgagaacgtgcgcggggtgatcaccatgaacgaggagtacgagacgaggttcctgtgcaactcttcacaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacaccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataatcatttctattttctggcttaccccttggaataagccaaaaataaaaccaaagttacatttcctgacagatggctaagaaaacaatagaaggaacatcctgaattctagagttgactcttgctggtgaagtacaccttcagcttagtccattctcctaagtaaagcctgaaggaaaactcttaacacctaattctttgtggaaaaatgatcaactagccatttcacaggctatagaacaaaagtacaattgggcatctttccttatgtcctgggatcaggggtgcttacatttaacattgatcaggtaaagaggagaggctgtgcctaaggtctgagaaaaggcttgctctaagcaagctgtggtgaggcacaggatgactagggaatggcagagaacaggctggcctactgtcagttcaagcaaccagctgagcagcagcagtctaaaaagccccaaacagaacacctccatggattcagggaagggctgaggcactgcctttctagtatgtgccaaaaaaaacataactctgaattggggcccaggggactttgagtttgtatggggagggaaaaggagtgagcagttctcctcccctccccacagccttaggccaacacaaactgcaaattggtaagcagcaccttaatacctcttgtgacagttacggctgaagtggcagggtcaagcttgtaggtgttggcatccccctttttatatcggtcccggaagacatagatgctcccgttacagctggcaatcttccagagggatggggcagagctccaggcctcaggaaggcaaagccgggtgaagctgtctagcaagggattgtagcacaccagggagtccccttcagccacgatgaacaccagatctttatgcacagctgcgtgcatgcggcctgcaaagggcagcacatagggcttcacatggcatttgtctgtctctgtgtcaaagcactggatgagtcgggaaggtttggtaaagaagtccagatcattctcctccccccctagtaagtagatgatcccgttgaggttggcaccagcagcccctgacacagccacctctagctgagttgtctctgtccacacattatcacctacgcgataataaatgactgcgttggagagggta

SEQ ID NO: 280671 - DNA, 950 bp, Homo sapiens
  misc_feature (49)..(49): n is a, c, g, or t
catactatattttcctacctgcaacaaacccccacattcaccccccacncctactagaaaaactgaaataaaagaggatcttaacctaggacacccagcagccagtgaaggaaccatgatctgaacgcaagtctttcaggctcaaaaacatgggctcaggacactgcactacacactgcctccaaaatctccaatttatgccagctactaataaagtatagatggggtctggaaaataatctccctgcatcaatgtcaagctgcttgtgtgcactaaattgctgactcccaactaaaaggctgagtcaatgcgatctcgctcccacttctggcagattgaggaaattctgcatggccctcaggtttactagaagagactgagaggctgtccgagggtcttcttccttacgcagaatctcagacaacaatccctgattaaatgggggaaaaaaacagaccaagtcacatttgcaggtatatgtgtgtggtttctgtcttccacccctctcctcctttgtttggtttaaccagctcgctgtgatgtcaagaacctcacactaattccttagggttctccgatatgaagtcaatgtgcttgccttccgggggatatgcattattttaggactgttctattctgacactttatcatcactgtaataatcatcagtgtacagacatgccagctagcaaggtaggcacttgggaagaattgtgaaactgcaattaccaccaggtgcctcctacaagtatttcaggaactgttagaactctctctgcttgaaactgggaacacttggcagtcctgcttagctttacaaatctgccaagtttggtaaatttagtttcgacatttaaacagcatggtagatttacatcaatttaaaaaaaaaactggctgaatttctgtatgaccggccactgttttcaatagagatatttcttatgca

SEQ ID NO: 280672 - DNA, 353 bp, Homo sapiens
atatgatgccaatttctactgttaggaacgcgataacagagtgcagtgggggagaaaataccgtcctcaagatctgagaaactggagaggaaaagtcacaggacaaccaacttctctatgacatagcccagcatctgaggaaagtcctgcaatagtggaggtggagcagagggtatgagctgggaagcaaatggagcaggagctggaggctgccccatccactccaagccagagaacaagcagaggctgccacaggagatcctgggcaagtaatcagccacagcatctagattagcatgaaggaaacactggccaaattaaaagatgaaacttccaaaaggtaaaaaaaagtg

SEQ ID NO: 280673 - DNA, 427 bp, Homo sapiens
cttccatagggagcgagaatgggcatgaaaagacctggagctcacttctggagccatcagttgtctgtcatatgacccagggtccctctgtctcagttaacccttctgaacaatgggataaaaccatctaccttttctcacagagctacacactgtaaggtgctatgcaaatagatgaaagtattatgcctacttccaacagaaacaatcagacgctaaaggaacagaagagtcacttgctctatccatgcatgatactgagcacctctcatgggaacatttactcttcagagtaatcccgggattatctccatttactgacatggcagctgaggcatagaggtgagcagtcgctgtgcccccaggacctgcagctaggcagcagtggggccaggactcagctgtgctactgacgccagggccaaat

SEQ ID NO: 280674 - DNA, 689 bp, Homo sapiens
cttccatagggagcgagaatgggcatgaaaagacctggagctcacttctggagccatcagttgtctgtcatatgacccagggtccctctgtctcagttaacccttctgaacaatgggataaaaccatctaccttttctcacagagctacacactgtaaggtgctatgcaaatagatgaaagtattatgcctacttccaacagaaacaatcagacgctaaaggaacagaagagtcacttgctctatccatgcatgatactgagcacctctcatgggaacatttactcttcagagtaatcccgggattatctccatttactgacatggcagctgaggcatagaggttcccaggtggtgccgatggtgttggtctacggaaaatctgagtagcaagcccttcagaggactcccagggcttcctgtctacaagaaccactggggctgagggagtggtcatcactctggattttgcagatgcaagatggagatccaggtgttaagtgtttcacccaagaccattcagcgttaagtgtttcacccaagacaattcagcaaattagtagcacaacccaagacaaccttgtggctaaatgcttagcccatttgggctcacctgttctagatcagaaaggaagccagcaggcctggagtctgcctgtgggaagaatcaaacttttcttttctggcctt

SEQ ID NO: 280675 - DNA, 665 bp, Homo sapiens
  misc_feature (631)..(631): n is a, c, g, or t
  misc_feature (637)..(637): n is a, c, g, or t
agtcccatcaagcagagaagtagacagcttcaggggaggcaggggtgagcagagctgccaagagcaaaaagaaaccattcatatcaccttagataccacggctcttcctactccaggtgcttcctggagaggtatagatgcaaaactataggagtctttagaagaagcaaccagccggactgtcttgaaacgcgatcagaaaaagccaagaatagagatggggttgttcaggaaaaatctgtgaggaccctcttttctgaatgtgtgaatcaatgtgacatacgtagaagacccacaagatttttgagaatgttctaccatcagaaacacttccaactgggcctaaaagggacagagacagaaaaaaatgaaagaagattgtgagactgccagaattctacagtgtatgcaatggtatgaggaactgttccacattaaaggagactaagaagacataacaactcgatgcaatgtgtgattctggactggatcttgcattggaggagaaaatgctataaaaggtatcactgagacagttaacatcattggaacatggatggttgattagatggaagtattacattaatgatacatttcctgaatttggtaactttgctattgttacctacangaatantctgctctaggaaacagtaatgagataa

SEQ ID NO: 280676 - DNA, 942 bp, Homo sapiens
tttgtccatttcacaatgtgaggatacagcaagaagtgtcatcttggaagcagagagcaaacactcatcagacattaaatctgacagcaccttgatcctggacttcccagcctctagaaattgtatgcaatggtatgaggaactgttccacattaaaggagactaagaagacataacaactcgatgcaatgtgtgattctggactggatcttgcattggaggagaaaatgctataaaagtgtcttgctctttcacccaggctggagtgcagtggcgccatctcagctcactgcaacctccgcctcccggattcaagcgattatcctgcctcagtctcctgagtagctgagattacagacacgtgccaccatgtccagcatatatatatatatttttgtagagatggggtttcaccatgttggccaagctggtctcctgaccttgtgatctgcccaccttggcctttttttctctatgtttctctgactcaacctttgacacttagaaggtagcacacttccaacatatccttccgtcttccaagatatagtccatacaactttccatagttcgaatgtttatcccccaaacctcatgttgaaatttgatccccaatgttggaagtggggcccgatgggaggaatttgggtcatggaggtggatccctcatgaatgacttgatgtcctccttgtggtaatgagtgagttcttgctccattagttcctgagaaagctggttgtttaaaaacaaaaacaaaaacctgtaagctcccttccctctctctttcttgtcatttggtctctgcacatgccagctccccttctccttctgccataaatggaattaacctaaagccctcaccagaagcagacgctggcactgtgcttcctgtgcagtctgcagaaccgtaaaccaaataaatctcctttcgttataaatta

SEQ ID NO: 280677 - DNA, 3549 bp, Homo sapiens
cactgggagacagtccacttaaatgcagctccagggttgcgaggcacccaccagcatcattccccgtgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcagtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactgggtaattctaagaacttttttttttctaaaaaaacaaaagtaacaacgaaataactcccaggactcacagaaaagaaacctggtgccttaacttctctctccctccccactttctccttttccttccttcctggcagtggttaaccttcctctttcttggacagattccactgaagagttaaccacatggctgatcctggtgactgaacttctgggcaaatctggatgctaattgctaactaaatgccctttttaaccagtctctgggttatacagacagaataccagccttttaactcccaaatcttgggggagaatgaaggaaacctggaagtcttgactctgtgctttctgcttagagtggctttgggaagtcttgtgcatactaaatttgggaagaatccccaaaagtgtcatgcttttaaacaagaatttcatggcacccatgtttgttgtttcttagcccaagagaatctaacttgctttgttgttctctttcccctgaagaaaaggagcagcatgtgttttgttctgtaatttgatgttgatcttctcagccacaccactgccctttgaatgtacaccttcatattttaacagctatgtaacttttccagggaaggttatttccattaaaggtattggctgctctgtgtgcaagagtctgttacaaagcttgctgtgcatgatcatggttaagccacaacatcaaaacccaagtccaggagttgctaactgcactcttttttattgtagttctcagcaaaaggaccccggaaacattgcaaactattctaatacctcagtttgaattgccactgagcactctaggtaaaaaataataaatactgcagctttattattaccttggatattgtatgcatgcttcaaagaagtcttttgaattaattacgctaatttatacccaatcccttaaaggtgacacagtcttcaagtttaggatcccaaagaggctctccctatgacaaattgtttggttgggttgtttttcttttaagtggtcatattttaatattatgtttgattcttttaattcagaatcaatatgtcactgaacaaattgatcatttctgtattttttgtaaatgtgtttactctattgtctctcttaacagagaagatatatttatgatatttctgcagactgcttcttataattcttagaattcttctgagtgaagtatgagaaaaatgagggcagggtgcagcggctcatgcctgtaagcccaacactttgggaggctgaggcaggtggattgcctgaggtcagtagttcaagaccaccctggccaacctggtgaaaccccgtctctattaaaaatacaaaaattagactggcatggtggcatgcgcctgtaatcccagctacccaggaggctgagacaggagaatcgcttgaacccaggaggtggaggttgcagtgagccaagatcgtgccacgcactgcaacctgggtgacagagcgagactccatctcaaaaaaaaaaaagaggttgggggaggagcttacatataaagccacgtagttaccaaaactctatttttaaaagctttcagatggacattttctagttcagatgtgtttgcttggtttaaatttaaatgaaatatatttaagaacacacataaacatagctgaagaaatcagcaaactggtttaataagggtggaaagaagagtccaaatacagtagcttaaatttagtcacttaactataaaaaactgaaaaagaaactttcttatattcaacattgaaacatagatgtaagaaatactactaatggtctcttaacatgatttgcctttttgtgtttgcttttgtttttgcaagcttaaaattttaaaaatctttcctgttactttcacctcaggtcgtaactttctttatgtgtttcattacagctccaaaaagccttccagaatttcctgaggcaaaaacacccttcccttttgagaaacctaggggcacattgggtaataagagtaccttaaatttaatattaaggctgtgggtggtgattgcttaattctgcaggacacatttactgcatcttatttctggaaacctcatgaactgatagttaggcaaacaaatggttgatttgatttttttttaataaatctatttggattttctgcaaattcggtaaaacccatcagtcttaattccacataatccacttagctttttgtccttaaaaatgctgacagtctgacaccaaactctggtctctctctgaccactaatcaaatgttctctggatggatacatactgatttcttactgatatataatgactttttattgtattggtatactgcaggcttctggtagccacttaaccataccagcaacctatttctgtctcgttctcctgtt

SEQ ID NO: 280678 - DNA, 2981 bp, Homo sapiens
ccatttaatgtatagtttatttctaggttttccttctgtgtttttagacactgaaatgcctaaatattgatttgtttattattttgtttctttatttttccagctcccggtaaaacacaatttatttctctgaaacctaaaatccctctcagcccagaagtgacacacaccaaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctgttctgaataggacaactacaagacctactaggcccaaacccagtgggatgcccagtgggaatggagtgggaacaggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccacttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagtttttttt

SEQ ID NO: 280679 - DNA, 3028 bp, Homo sapiens
cactgggagacagtccacttaaatgcagctccagggttgcgaggcacccaccagcatcattccccgtgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcagtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactgggtaattctaagaacttttttttttctaaaaaaacaaaagtaacaacgaaataactcccaggactcacagaaaagaaacctggtgccttaacttctctctccctccccactttctccttttccttccttcctggcagtggttaaccttcctctttcttggacagattccactgaagagttaaccacatggctgatcctggtgactgaacttctgggcaaatctggatgctaattgctaactaaatgccctttttaaccagtctctgggttatacagacagaataccagccttttaactcccaaatcttgggggagaatgaaggaaacctggaagtcttgactctgtgctttctgcttagagtggctttgggaagtcttgtgcatactaaatttgggaagaatccccaaaagtgtcatgcttttaaacaagaatttcatggcacccatgtttgttgtttcttagcccaagagaatctaacttgctttgttgttctctttcccctgaagaaaaggagcagcatgtgttttgttctgtaatttgatgttgatcttctcagccacaccactgccctttgaatgtacaccttcatattttaacagctatgtaacttttccagggaaggttatttccattaaaggtattggctgctctgtgtgcaagagtctgttacaaagcttgctgtgcatgatcatggttaagccacaacatcaaaacccaagtccaggagttgctaactgcactcttttttattgtagttctcagcaaaaggaccccggaaacattgcaaactattctaatacctcagtttgaattgccactgagcactctagcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggttcctgccacaatcctcgaaccagttcttagaactgaggcttcagggacaacagcagctcccaaagtgcctcaacgaactcatcgtccacatcccaaacctaaaaccacactgagtcccgaagagcttcagactgaactggttcctgctacaatctttgaaccagtttctcctataaaagaggctccagggacaacattcgttcctgttacagacctcgagcctgttacttttagaactgagatccctgcaacaaccttagctacc

SEQ ID NO: 280680 - DNA, 4130 bp, Homo sapiens
agcggggggtacggctggctgcacttttatgcagagccgaaatatctgatagttgtgcgacctgctccacctccaagtcaaaagaagtcatgttcaggtaaaactcgttctcgcaaacctctgcagctggtggttggcactctgacaccgagctcagtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggttctcagcaaaaggaccccggaaacattgcaaactattctaatacctcagtttgaattgccactgagcactctagcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggcgccacacagattttatactactgtgaggcccagaacatctgacaagccacacatcagacctggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccacttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagtttttttt

SEQ ID NO: 280681 - DNA, 4604 bp, Homo sapiens
  misc_feature (228)..(228): n is a, c, g, or t
  misc_feature (235)..(235): n is a, c, g, or t
taggtaatttgcaaagaacagaagtttatttttcacggttctggaagctgggaagtccatgatcaaagtgctggcatctggtgagggccttcttgctgcatccttccttgcagatttgtagatagatgcaaaagattccacgtgtaaagtattgttaatactattacttcttgttgtatggtagaattctaattagaagacattttccctgcccaatctcttgccagntgagctntatgattctttccttggattcctggtggcaggacagggagagtcatttgaacagaaagcccatgctatgtgatcccttttcgactccgtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcagtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggttctcagcaaaaggaccccggaaacattgcaaactattctaatacctcagtttgaattgccactgagcactctagcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggcgccacacagattttatactactgtgaggcccagaacatctgacaagccacacatcagacctggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccacttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagtttttttt

SEQ ID NO: 280682 - DNA, 818 bp, Homo sapiens
atccccggaagaggaacctcactcagactctactgccatcacagtcaacaataggacctgaaacaccaggaaccaaaccttcaacaacattagcaccacgaaagaccaaaagaccaggtcgtcgcccccgcccccgtccccgccctaaaaccacacctagtccagaagtgcccaagtccaaacccgctctggaacctgccacgatacaaccggagcccttggtgcccacaactgtctctgagcctgttccatttgaaactgaagctccctcaatgaccatagttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggttcctgccacaatcctcgaaccagttcttagaactgaggcttcagggacaacagcagctcccaaagtgcctcaacgaactcatcgtccacatcccaaacctaaaaccacactgagtcccgaagagcttcagactgaactggttcctgctacaatctttgaaccagtttctcctataaaagaggctccagggacaacattcgttcctgttacagacctcgagcctgttacttttagaactgagatccctgcaacaaccttagctacc

SEQ ID NO: 280683 - DNA, 527 bp, Homo sapiens
gtatagtttataaactgtatctcattttttaaaagttgcctgtcctgacataattagtgaatttaaagccttctgcatatattgttgatttgtggatattttaaatgctaagtgaaaaatttatctgtttaaatcttaggccaaattttaatttttatcccaaatggctttataaaagcaacctttctcatgttcctgttgaacatatgccttcaatatttttgagtgactatcttctctaagctgtacaaagttttgagattttccatctcaaaatggaagaacagacagatctcttggacagtttattaatctgtgacaaaaaaattattcaagacctcatttaactacataaataatgatagaagtttgcaaaacagatggaaacatgtccacagtaaatcaaagggtttaaatgtccttctaagatggatgtaatatttatcatcagtttgtaaatccacccttcttgtattaacttgctaattttctttcttcagcaccacgaaagaccaaaagaccaggtc

SEQ ID NO: 280684 - DNA, 4447 bp, Homo sapiens
cactgggagacagtccacttaaatgcagctccagggttgcgaggcacccaccagcatcattccccgtgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcagtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggttctcagcaaaaggaccccggaaacattgcaaactattctaatacctcagtttgaattgccactgagcactctagcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggcgccacacagattttatactactgtgaggcccagaacatctgacaagccacacatcagacctggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccacttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagtttttttt

SEQ ID NO: 280685 - DNA, 2847 bp, Homo sapiens
cactgggagacagtccacttaaatgcagctccagggttgcgaggcacccaccagcatcattccccgtgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcagtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactgggtaattctaagaacttttttttttctaaaaaaacaaaagtaacaacgaaataactcccaggactcacagaaaagaaacctggtgccttaacttctctctccctccccactttctccttttccttccttcctggcagtggttaaccttcctctttcttggacagattccactgaagagttaaccacatggctgatcctggtgactgaacttctgggcaaatctggatgctaattgctaactaaatgccctttttaaccagtctctgggttatacagacagaataccagccttttaactcccaaatcttgggggagaatgaaggaaacctggaagtcttgactctgtgctttctgcttagagtggctttgggaagtcttgtgcatactaaatttgggaagaatccccaaaagtgtcatgcttttaaacaagaatttcatggcacccatgtttgttgtttcttagcccaagagaatctaacttgctttgttgttctctttcccctgaagaaaaggagcagcatgtgttttgttctgtaatttgatgttgatcttctcagccacaccactgccctttgaatgtacaccttcatattttaacagctatgtaacttttccagggaaggttatttccattaaaggtattggctgctctgtgtgcaagagtctgttacaaagcttgctgtgcatgatcatggttaagccacaacatcaaaacccaagtccaggagttgctaactgcactcttttttattgtagttctcagcaaaaggaccccggaaacattgcaaactattctaatacctcagtttgaattgccactgagcactctagcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttac

SEQ ID NO: 280686 - DNA, 728 bp, Homo sapiens
ctttagcctcaaaaccatctgagagacctaaaaccacacacagaccagatgcacctcaaattcagcctggttcaaaaccaccaaaacaattacttcctaaaccccaaaccacagcagaaccagacatgccaccaactaaatccgtctctgagcctgttccatttgaaactgaagctccctcaatgaccatagttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggttcctgccacaatcctcgaaccagttcttagaactgaggcttcagggacaacagcagctcccaaagtgcctcaacgaactcatcgtccacatcccaaacctaaaaccacactgagtcccgaagagcttcagactgaactggttcctgctacaatctttgaaccagtttctcctataaaagaggctccagggacaacattcgttcctgttacagacctcgagcctgttacttttagaactgagatccctgcaacaaccttagctacc

SEQ ID NO: 280687 - DNA, 941 bp, Homo sapiens
  misc_feature (933)..(933): n is a, c, g, or t
  misc_feature (937)..(940): n is a, c, g, or t
ggggcgcacagatgaaaacaccctgcggacaccgtaactataaacccgactcctcccgaggagcgacggtccgagcggacgctagcgggcccagcagacacgagcagagcgggccaggcctctctaacgtccgggccaaacccgtccttcaccccaaaaccagttcatctcctcggaactcacccaggccagtgaggccttaactctgaaaggcaaaaagactctcaggcgctcacagccggcgtcacaaaaggaacggcgcaccgctgacgtcatttacgctctccgcctcgggccaggcggggtttcgggactagggtttctgccgtgtaatacctcctcgaggcagaaaaattctactttccatctgcttggctgcggaggaccttggggtgggctcagcgtgggggctgcaggcagaaatgggtccagaaggcaaggtcgaggttagagccaagcctgtgggcagggctacgggcagggggcggggaggaatgtgggtccaggcccagaggaaaaggttgaagttatagccaggcctgtgggcgaggccgcagcagggcggccataggggaaggagccaatgtgttatgcatgtagaaaatagatggcctggagcaactgaagaaccacaaaagaagtgaaacagccagttcctgccttaactgatgacgttccaccattgtgatttgttgctgccccaccccaactgatctcttgaccttgtgacattcttcttctggacgagtctcaggagttccccaccgagcaccttgtgacccccggccctgccagcaaaagataaccacctttaactttccactacctacccaaatcctataaaactgccccacccctatctccctttgctgacccctttctcgcactcagcccacttgcacccaagtgaataaacagccttgttgctaacanaaannnna

SEQ ID NO: 280688 - DNA, 1348 bp, Homo sapiens
  misc_feature (1340)..(1340): n is a, c, g, or t
  misc_feature (1344)..(1347): n is a, c, g, or t
ggggcgcacagatgaaaacaccctgcggacaccgtaactataaacccgactcctcccgaggagcgacggtccgagcggacgctagcgggcccagcagacacgagcagagcgggccaggcctctctaacgtccgggccaaacccgtccttcaccccaaaaccagttcatctcctcggaactcacccaggccagtgaggccttaactctgaaaggcaaaaagactctcaggcgctcacagccggcgtcacaaaaggaacggcgcaccgctgacgtcatttacgctctccgcctcgggccaggcggggtttcgggactagggtttctgccgtgtaatacctcctcgaggcagaaaaattctactttccatctgcttggctgcggaggaccttggggtgggctcagcgtgggggctgcaggcagaaatgggtccagaaggcaaggtcgaggttagagccaagcctgtgggcagggctacgggcagggggcggggaggaatgtgggtccaggcccagaggaaaaggttgaagttatagccaggcctgtgggcgaggccgcagcagggcggccataggggaaggagccaatgtgttatgcatgtagaaaataggtaactacgtcttttgctctgttactatttcaacatttgatgtaaaaaacattttctatgcagctaaaggaattgtttttaaaaataatttctaggttttctgccttgctttaaaacatcttttctttttttttgagacaaaatctcactctgtcaccaaggctggagttcagtggagccatctcagctcactgcaacctccacctcccaggttcaagcgattctcctgcctcatcctcccaagtagctggaattacaggtgcatgctgccacaccctgctaatttttgtatttttagtagaggcagggttttgccatgctggccaggctggtcttgaactacttgtcaggcctctgagcccaagttaaatcatcataaaccctgtcacctgcacgtatacatccagatggcctggagcaactgaagaaccacaaaagaagtgaaacagccagttcctgccttaactgatgacgttccaccattgtgatttgttgctgccccaccccaactgatctcttgaccttgtgacattcttcttctggacgagtctcaggagttccccaccgagcaccttgtgacccccggccctgccagcaaaagataaccacctttaactttccactacctacccaaatcctataaaactgccccacccctatctccctttgctgacccctttctcgcactcagcccacttgcacccaagtgaataaacagccttgttgctaacanaaannnna

SEQ ID NO: 280689 - DNA, 1211 bp, Homo sapiens
  misc_feature (1203)..(1203): n is a, c, g, or t
  misc_feature (1207)..(1210): n is a, c, g, or t
ggggcgcacagatgaaaacaccctgcggacaccgtaactataaacccgactcctcccgaggagcgacggtccgagcggacgctagcgggcccagcagacacgagcagagcgggccaggcctctctaacgtccgggccaaacccgtccttcaccccaaaaccagttcatctcctcggaactcacccaggccagtgaggccttaactctgaaaggcaaaaagactctcaggcgctcacagccggcgtcacaaaaggaacggcgcaccgctgacgtcatttacgctctccgcctcgggccaggcggggtttcgggactagggtttctgccgtgtaatacctcctcgaggcagaaaaattctactttccatctgcttggctgcggaggaccttggggtgggctcagcgtgggggctgcaggcagaaatgggtccagaaggcaaggtcgaggttagagccaagcctgtgggcagggctacgggcagggggcggggaggaatgtgggtccaggcccagaggaaaaggttgaagttatagccaggcctgtgggcgaggccgcagcagggcggccataggggaaggagccaatgtgttatgcatgtagaaaatagacaaaatctcactctgtcaccaaggctggagttcagtggagccatctcagctcactgcaacctccacctcccaggttcaagcgattctcctgcctcatcctcccaagtagctggaattacaggtgcatgctgccacaccctgctaatttttgtatttttagtagaggcagggttttgccatgctggccaggctggtcttgaactacttgtcaggcctctgagcccaagttaaatcatcataaaccctgtcacctgcacgtatacatccagatggcctggagcaactgaagaaccacaaaagaagtgaaacagccagttcctgccttaactgatgacgttccaccattgtgatttgttgctgccccaccccaactgatctcttgaccttgtgacattcttcttctggacgagtctcaggagttccccaccgagcaccttgtgacccccggccctgccagcaaaagataaccacctttaactttccactacctacccaaatcctataaaactgccccacccctatctccctttgctgacccctttctcgcactcagcccacttgcacccaagtgaataaacagccttgttgctaacanaaannnna

SEQ ID NO: 280690 - DNA, 369 bp, Homo sapiens
tctttagacttcctcttagaagaggactgacacctgagtacatcctgcgaagacaaacgacggaagtattctctagggaaaagttcattttcatcctcttcctcctcttcttcatcgatctcaaacacggagtcttgctatgtcacgcaggttggactacagtggctatttacagcggcccctccgagatggctggctatttgcaggaagactatcatgaggaaggacttgtttgctcaaacgtgtagaactgactggagccataacttctggtttcttttcactttctactgaataagaatcttgttctttgttctcatgagacacagactttcccacctgattttagaaaataaaacaatgctggtt

SEQ ID NO: 280691 - DNA, 636 bp, Homo sapiens
ccccccacaatattgggtcccctcaaaagggccaaaaaaccggaggggggtcccatcctttgggttcccccacccctgagcaacctgcatggcagagaacaaaataaatattggctaaattctagagattccatcattaagttctgcccaccatgtcccaaggattcctgctcacctgtacttgtgagcgcaactgatccatcttctgctgctgcttctccacaatctgaaaggcaaagttatcaaggaaggctgcgagcacaaggctgacgcctaccctccgttacagcctggacaccctcagtcaccttttggagcgaatcgtatcgcttctgccaggactccatttccacttctggaccttctccactggtctcctccacagactgtttatcttgcaggctgaaagacagtggcctcttcaagaactctgaagttagacacaagtggctttgattcttggttctgctatttattgcacattttgaggcaagacacttagtccaagcagtagctggggataatacttgggtctgctgtaatatatggggtgccacacaaaagctgctcagtgtatgttaattctcttccctaagggccagaatctatacaatgtgacaccaattctctacctgc

SEQ ID NO: 280692 - DNA, 2756 bp, Homo sapiens
ggcggccgcaatagtacgctcgcgcggcggtggcgggtggtggtccttggaccacgcggtgggcggacagcggcacggcctcccctcccctccggacgcaggccgaagtacgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactgaagacaatgggaaagaaaataaaactccctcctctgatgcacaggataagcagtttggtacttggagactgagagtcacacctgtcgattaccttctgggagtggctgacttaactggagaattgatgcggatgtgtattaacagtgtggggaatggggacattgataccccctttgaagtgagccagtttttacgtcaggtttatgatgggttttcattcattggcaacactggaccttacgaggtttctaagaagctgtataccttgaaacaaagtttggccaaagtggagaatgcttgttatgccttgaaagtcagagggtcagaaattccaaaacatatgttggcagatgtgttttcagttaaaacagaaatgatagatcaagaagagggcatttcttagaatctaacgttactcagttactaattcttttgagaactcctaagagaccaatttgtaagacttatttagtatttcatttaactttattgtggcttttacatagaaacatattcagttgtacttgttttaaattgtatacaagctgtacataaaattagccaaatgaatcatttcttatatcttattcatgaaagtttgcatacagatgtttgcatatatgcctttttgaatttttgctggttaacctttatcatttatctttgtaatgtgaacatgcttcagagtgtaccttttgccataacctattttaatttactttttctgaagtttggagtgataatttttagtggaagcaatttgtaatttaagttggtagttatattatatatagaaaagattttttagttaaacttctggacatgagcgtcctgtttaaatttcttgttaatatcgtgccaagcctcaaaaataggcttattccatggaacaagaattaaaaatgaataagctatcaatatataatttaagtacaagtttaggctgggcgtggtggctcacgcctgtaatcccagcactttgggaggccgaggtaggcagatcacgaggtcaagagatcaagaccagcctgaccaacgtggcgaaacctcgtctctactagaaatacaaaaattagctggatatggtggtatgtgcctgtaatcccagctacttgggaggctgaggcaggagactcgcttgaacctgggaggcagaggttgcagtgagccgagattgcgccactgcactccagcctgggtaacagagcaagactccatctcaaaaaaagaaagaaagaaaaaagaaagtacaagtttataaagtattatagtgaaaaattcgcattctggctgattttaagccatttaaaatttatataaaacaaccttccataaaaatttgacaggtgcccagatgttgctttctccatttattttttgtttttttttaatcacagtaggtctgatagagaattggagctaaattataatatttttgttggtaaagttgagttatatacttgtacatacaatggaaatgcttttagtagtgattatttagcaatttttgtttttgttatattaggcatgtttggaggctttcctattctagcatttaaatttaaattttattaaaattaaataatttaaatctagcatttaaatttaaataatttaagtctagcatttacttttaaataattataatgaagttttgaaatactaagttaatccagacctttagttgtcccatggtgttaataaagttgccaaagaagatgtattatgaacaattcagcaataagacaattgtcaacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagt

SEQ ID NO: 280693 - DNA, 580 bp, Homo sapiens
gcggccgcctactactactaaattcgcggccgcgtcgactgcttttagtagtgattatttagcaatttttgtttttgttatattaggcatgtttggaggctttcctattctagcatttaaatttaaattttattaaaattaaataatttaaatctagcatttaaatttaaataatttaagtctagcatttacttttaaataattataatgaagttttgaaatactaagttaatccagacctttagttgtcccatggtgttaataaagttgccaaagaagatgtattatgaacaattcagcaataagacaattgtcaacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagt

SEQ ID NO: 280694 - DNA, 2832 bp, Homo sapiens
ggcggccgcaatagtacgctcgcgcggcggtggcgggtggtggtccttggaccacgcggtgggcggacagcggcacggcctcccctcccctccggacgcaggccgaagtacgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactgaagacaatgggaaagaaaataaaactccctcctctgatgcacaggataagcagtttggtacttggagactgagagtcacacctgtcgattaccttctgggagtggctgacttaactggagaattgatgcggatgtgtattaacagtgtggggaatggggacattgataccccctttgaagtgagccagtttttacgtcaggtttatgatgggttttcattcattggcaacactggaccttacgaggtttctaagaagctgtataccttgaaacaaagtttggccaaagtggagaatgcttgttatgccttgaaagtcagagggtcagaaattccaaaacatatgttggcagatgtgttttcagttaaaacagaaatgatagatcaagaagagggcatttcttagaatctaacgttactcagttactaattcttttgagaactcctaagagaccaatttgtaagacttatttagtatttcatttaactttattgtggcttttacatagaaacatattcagttgtacttgttttaaattgtatacaagctgtacataaaattagccaaatgaatcatttcttatatcttattcatgaaagtttgcatacagatgtttgcatatatgcctttttgaatttttgctggttaacctttatcatttatctttgtaatgtgaacatgcttcagagtgtaccttttgccataacctattttaatttactttttctgaagtttggagtgataatttttagtggaagcaatttgtaatttaagttggtagttatattatatatagaaaagattttttagttaaacttctggacatgagcgtcctgtttaaatttcttgttaatatcgtgccaagcctcaaaaataggcttattccatggaacaagaattaaaaatgaataagctatcaatatataatttaagtacaagtttaggctgggcgtggtggctcacgcctgtaatcccagcactttgggaggccgaggtaggcagatcacgaggtcaagagatcaagaccagcctgaccaacgtggcgaaacctcgtctctactagaaatacaaaaattagctggatatggtggtatgtgcctgtaatcccagctacttgggaggctgaggcaggagactcgcttgaacctgggaggcagaggttgcagtgagccgagattgcgccactgcactccagcctgggtaacagagcaagactccatctcaaaaaaagaaagaaagaaaaaagaaagtacaagtttataaagtattatagtgaaaaattcgcattctggctgattttaagccatttaaaatttatataaaacaaccttccataaaaatttgacaggtgcccagatgttgctttctccatttattttttgtttttttttaatcacagtaggtctgatagagaattggagctaaattataatatttttgttggtaaagttgagttatatacttgtacatacaatggaaatgcttttagtagtgattatttagcaatttttgtttttgttatattaggcatgtttggaggctttcctattctagcatttaaatttaaattttattaaaattaaataatttaaatctagcatttaaatttaaataatttaagtctagcatttacttttaaataattataatgaagttttgaaatactaagttaatccagacctttagttgtcccatggtgttaataaagttgccaaagaagatgtattatgaacaattcagcaataagacaattgtcaacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagttaaaaaaaaagacaagaaaaaaacacgaaaacacaaaacttttggggcgagtttgggcctcggagaaaagttttaa

SEQ ID NO: 280695 - DNA, 2695 bp, Homo sapiens
ggcggccgcaatagtacgctcgcgcggcggtggcgggtggtggtccttggaccacgcggtgggcggacagcggcacggcctcccctcccctccggacgcaggccgaagtacgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactgaagacaatgggaaagaaaataaaactccctcctctgatgcacaggataagcagtttggtacttggagactgagagtcacacctgtcgattaccttctgggagtggctgacttaactggagaattgatgcggatgtgtattaacagtgtggggaatggggacattgataccccctttgaagtgagccagtttttacgtcaggtttatgatgggttttcattcattggcaacactggaccttacgaggtttctaagaagctgtataccttgaaacaaagtttggccaaagtggagaatgcttgttatgccttgaaagtcagagggtcagaaattccaaaacatatgttggcagatgtgttttcagttaaaacagaaatgatagatcaagaagagggcatttcttagaatctaacgttactcagttactaattcttttgagaactcctaagagaccaatttgtaagacttatttagtatttcatttaactttattgtggcttttacatagaaacatattcagttgtacttgttttaaattgtatacaagctgtacataaaattagccaaatgaatcattttgctggttaacctttatcatttatctttgtaatgtgaacatgcttcagagtgtaccttttgccataacctattttaatttactttttctgaagtttggagtgataatttttagtggaagcaatttgtaatttaagttggtagttatattatatatagaaaagattttttagttaaacttctggacatgagcgtcctgtttaaatttcttgttaatatcgtgccaagcctcaaaaataggcttattccatggaacaagaattaaaaatgaataagctatcaatatataatttaagtacaagtttaggctgggcgtggtggctcacgcctgtaatcccagcactttgggaggccgaggtaggcagatcacgaggtcaagagatcaagaccagcctgaccaacgtggcgaaacctcgtctctactagaaatacaaaaattagctggatatggtggtatgtgcctgtaatcccagctacttgggaggctgaggcaggagactcgcttgaacctgggaggcagaggttgcagtgagccgagattgcgccactgcactccagcctgggtaacagagcaagactccatctcaaaaaaagaaagaaagaaaaaagaaagtacaagtttataaagtattatagtgaaaaattcgcattctggctgattttaagccatttaaaatttatataaaacaaccttccataaaaatttgacaggtgcccagatgttgctttctccatttattttttgtttttttttaatcacagtaggtctgatagagaattggagctaaattataatatttttgttggtaaagttgagttatatacttgtacatacaatggaaatgcttttagtagtgattatttagcaatttttgtttttgttatattaggcatgtttggaggctttcctattctagcatttaaatttaaattttattaaaattaaataatttaaatctagcatttaaatttaaataatttaagtctagcatttacttttaaataattataatgaagttttgaaatactaagttaatccagacctttagttgtcccatggtgttaataaagttgccaaagaagatgtattatgaacaattcagcaataagacaattgtcaacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagt

SEQ ID NO: 280696 - DNA, 2626 bp, Homo sapiens
aagcactggtatcaacgcagagtgcccattatgccgggggcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactgaagacaatgggaaagaaaataaaactccctcctctgatgcacaggataagcagtttggtacttggagactgagagtcacacctgtcgattaccttctgggagtggctgacttaactggagaattgatgcggatgtgtattaacagtgtggggaatggggacattgataccccctttgaagtgagccagtttttacgtcaggtttatgatgggttttcattcattggcaacactggaccttacgaggtttctaagaagctgtataccttgaaacaaagtttggccaaagtggagaatgcttgttatgccttgaaagtcagagggtcagaaattccaaaacatatgttggcagatgtgttttcagttaaaacagaaatgatagatcaagaagagggcatttcttagaatctaacgttactcagttactaattcttttgagaactcctaagagaccaatttgtaagacttatttagtatttcatttaactttattgtggcttttacatagaaacatattcagttgtacttgttttaaattgtatacaagctgtacataaaattagccaaatgaatcatttcttatatcttattcatgaaagtttgcatacagatgtttgcatatatgcctttttgaatttttgctggttaacctttatcatttatctttgtaatgtgaacatgcttcagagtgtaccttttgccataacctattttaatttactttttctgaagtttggagtgataatttttagtggaagcaatttgtaatttaagttggtagttatattatatatagaaaagattttttagttaaacttctggacatgagcgtcctgtttaaatttcttgttaatatcgtgccaagcctcaaaaataggcttattccatggaacaagaattaaaaatgaataagctatcaatatataatttaagtacaagtttaggctgggcgtggtggctcacgcctgtaatcccagcactttgggaggccgaggtaggcagatcacgaggtcaagagatcaagaccagcctgaccaacgtggcgaaacctcgtctctactagaaatacaaaaattagctggatatggtggtatgtgcctgtaatcccagctacttgggaggctgaggcaggagactcgcttgaacctgggaggcagaggttgcagtgagccgagattgcgccactgcactccagcctgggtaacagagcaagactccatctcaaaaaaagaaagaaagaaaaaagaaagtacaagtttataaagtattatagtgaaaaattcgcattctggctgattttaagccatttaaaatttatataaaacaaccttccataaaaatttgacaggtgcccagatgttgctttctccatttattttttgtttttttttaatcacagtaggtctgatagagaattggagctaaattataatatttttgttggtaaagttgagttatatacttgtacatacaatggaaatgcttttagtagtgattatttagcaatttttgtttttgttatattaggcatgtttggaggctttcctattctagcatttaaatttaaattttattaaaattaaataatttaaatctagcatttaaatttaaataatttaagtctagcatttacttttaaataattataatgaagttttgaaatactaagttaatccagacctttagttgtcccatggtgttaataaagttgccaaagaagatgtattatgaacaattcagcaataagacaattgtcaacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagt

SEQ ID NO: 280697 - DNA, 2376 bp, Homo sapiens
ccgggctgcaggctcgtgccgaattcggcacgagttcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggactacaggaatatgtggaagctgtctcttttcaacacttcatcaaaacacgatcattaattagtatggatgaaattaataaacaattgatatttacgactgaagacaatgggaaagaaaataaaactccctcctctgatgcacaggataagcagtttggtacttggagactgagagtcacacctgtcgattaccttctgggagtggctgacttaactggagaattgatgcggatgtgtattaacagtgtggggaatggggacattgataccccctttgaagtgagccagtttttacgtcaggtttatgatgggttttcattcattggcaacactggaccttacgaggtttctaagaagctgtataccttgaaacaaagtttggccaaagtggagaatgcttgttatgccttgaaagtcagagggtcagaaattccaaaacatatgttggcagatgtgttttcagttaaaacagaaatgatagatcaagaagagggcatttcttagaatctaacgttactcagttactaattcttttgagaactcctaagagaccaatttgtaagacttatttagtatttcatttaactttattgtggcttttacatagaaacatattcagttgtacttgttttaaattgtatacaagctgtacataaaattagccaaatgaatcatttcttatatcttattcatgaaagtttgcatacagatgtttgcatatatgcctttttgaatttttgctggttaacctttatcatttatctttgtaatgtgaacatgcttcagagtgtaccttttgccataacctattttaatttactttttctgaagtttggagtgataatttttagtggaagcaatttgtaatttaagttggtagttatattatatatagaaaagattttttagttaaacttctggacatgagcgtcctgtttaaatttcttgttaatatcgtgccaagcctcaaaaataggcttattccatggaacaagaattaaaaatgaataagctatcaatatataatttaagtacaagtttaggctgggcgtggtggctcacgcctgtaatcccagcactttgggaggccgaggtaggcagatcacgaggtcaagagatcaagaccagcctgaccaacgtggcgaaacctcgtctctactagaaatacaaaaattagctggatatggtggtatgtgcctgtaatcccagctacttgggaggctgaggcaggagactcgcttgaacctgggaggcagaggttgcagtgagccgagattgcgccactgcactccagcctgggtaacagagcaagactccatctcaaaaaaagaaagaaagaaaaaagaaagtacaagtttataaagtattatagtgaaaaattcgcattctggctgattttaagccatttaaaatttatataaaacaaccttccataaaaatttgacaggtgcccagatgttgctttctccatttattttttgtttttttttaatcacagtaggtctgatagagaattggagctaaattataatatttttgttggtaaagttgagttatatacttgtacatacaatggaaatgcttttagtagtgattatttagcaatttttgtttttgttatattaggcatgtttggaggctttcctattctagcatttaaatttaaattttattaaaattaaataatttaaatctagcatttaaatttaaataatttaagtctagcatttacttttaaataattataatgaagttttgaaatactaagttaatccagacctttagttgtcccatggtgttaataaagttgccaaagaagatgtattatgaacaattcagcaataagacaattgtcaacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagt

SEQ ID NO: 280698 - DNA, 2024 bp, Homo sapiens
atctagaggatcccggtcattttctacaccccctcctctgatgcacaggataagcagtttggtacttggagactgagagtcacacctgtcgattaccttctgggagtggctgacttaactggagaattgatgcggatgtgtattaacagtgtggggaatggggacattgataccccctttgaagtgagccagtttttacgtcaggtttatgatgggttttcattcattggcaacactggaccttacgaggtttctaagaagctgtataccttgaaacaaagtttggccaaagtggagaatgcttgttatgccttgaaagtcagagggtcagaaattccaaaacatatgttggcagatgtgttttcagttaaaacagaaatgatagatcaagaagagggcatttcttagaatctaacgttactcagttactaattcttttgagaactcctaagagaccaatttgtaagacttatttagtatttcatttaactttattgtggcttttacatagaaacatattcagttgtacttgttttaaattgtatacaagctgtacataaaattagccaaatgaatcatttcttatatcttattcatgaaagtttgcatacagatgtttgcatatatgcctttttgaatttttgctggttaacctttatcatttatctttgtaatgtgaacatgcttcagagtgtaccttttgccataacctattttaatttactttttctgaagtttggagtgataatttttagtggaagcaatttgtaatttaagttggtagttatattatatatagaaaagattttttagttaaacttctggacatgagcgtcctgtttaaatttcttgttaatatcgtgccaagcctcaaaaataggcttattccatggaacaagaattaaaaatgaataagctatcaatatataatttaagtacaagtttaggctgggcgtggtggctcacgcctgtaatcccagcactttgggaggccgaggtaggcagatcacgaggtcaagagatcaagaccagcctgaccaacgtggcgaaacctcgtctctactagaaatacaaaaattagctggatatggtggtatgtgcctgtaatcccagctacttgggaggctgaggcaggagactcgcttgaacctgggaggcagaggttgcagtgagccgagattgcgccactgcactccagcctgggtaacagagcaagactccatctcaaaaaaagaaagaaagaaaaaagaaagtacaagtttataaagtattatagtgaaaaattcgcattctggctgattttaagccatttaaaatttatataaaacaaccttccataaaaatttgacaggtgcccagatgttgctttctccatttattttttgtttttttttaatcacagtaggtctgatagagaattggagctaaattataatatttttgttggtaaagttgagttatatacttgtacatacaatggaaatgcttttagtagtgattatttagcaatttttgtttttgttatattaggcatgtttggaggctttcctattctagcatttaaatttaaattttattaaaattaaataatttaaatctagcatttaaatttaaataatttaagtctagcatttacttttaaataattataatgaagttttgaaatactaagttaatccagacctttagttgtcccatggtgttaataaagttgccaaagaagatgtattatgaacaattcagcaataagacaattgtcaacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagt

SEQ ID NO: 280699 - DNA, 1030 bp, Homo sapiens
  misc_feature (876)..(876): n is a, c, g, or t
  misc_feature (949)..(949): n is a, c, g, or t
ggcggccgcaatagtacgctcgcgcggcggtggcgggtggtggtccttggaccacgcggtgggcggacagcggcacggcctcccctcccctccggacgcaggccgaagtacgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactgaagacaatgggaaagaaaataaaactccctcctctgatgcacaggataagcagtttggtatctatgactccgtgaaggtctacttcagacttcctcgccctcctccacccgagatgccagagtctctgaagaagaagctngggttaactcagtagttagatcaaagcaaatgtggactgaatctgcttgttgatcagtgttgaagaaagtgcnaaaggaacttttatatatttgacagtgtaggaaattgcctattcctgatataattactgtagtactaatgctagggcagag

SEQ ID NO: 280700 - DNA, 786 bp, Homo sapiens
ggcggccgcaatagtacgctcgcgcggcggtggcgggtggtggtccttggaccacgcggtgggcggacagcggcacggcctcccctcccctccggacgcaggccgaagtacgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactgaagacaatgggaaagaaaataaaactactgtgagaatttaaaatttattt

SEQ ID NO: 280701 - DNA, 377 bp, Homo sapiens
gcggccgcctactactactaaattcgcggccgcgtcgacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagttaaaaaaaaagacaagaaaaaaacacgaaaacacaaaacttttggggcgagtttgggcctcggagaaaagttttaa

SEQ ID NO: 280702 - DNA, 479 bp, Homo sapiens
cggacagcggcacggcctcccctcccctccggacgcaggccgaagtacgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggtggcgtccttaacaacacggggcgttatttatccggagggggaggttctccagtctttctatgcagttttccccttttcacccttgaaggatgccttcgtcccttgtagactcgggggcggcccctctgtttctctccccggccagatcggccctgtttacacctccttttttcttaaatttttgaggtgtgattttatcctagttcagtaattgctgtaatgccagatcatagcaccagttggtggaaacttggatg

SEQ ID NO: 280703 - DNA, 472 bp, Homo sapiens
ccatggtgttaataaagttgccaaagaagatgtattatgaacaattcagcaataagacaattgtcaacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagtaaattctgtttttttgtttgttcgtgttagtgatggtgggttttttggttttgcaactcacctgtagtcaactcactacaggtgagttggtgccattgctactgatatatctccacagttcatgtcatactaatactgtggg

SEQ ID NO: 280704 - DNA, 900 bp, Homo sapiens
  misc_feature (746)..(746): n is a, c, g, or t
  misc_feature (819)..(819): n is a, c, g, or t
aagcactggtatcaacgcagagtgcccattatgccgggggcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactgaagacaatgggaaagaaaataaaactccctcctctgatgcacaggataagcagtttggtatctatgactccgtgaaggtctacttcagacttcctcgccctcctccacccgagatgccagagtctctgaagaagaagctngggttaactcagtagttagatcaaagcaaatgtggactgaatctgcttgttgatcagtgttgaagaaagtgcnaaaggaacttttatatatttgacagtgtaggaaattgcctattcctgatataattactgtagtactaatgctagggcagag

SEQ ID NO: 280705 - DNA, 2702 bp, Homo sapiens
ggcggccgcaatagtacgctcgcgcggcggtggcgggtggtggtccttggaccacgcggtgggcggacagcggcacggcctcccctcccctccggacgcaggccgaagtacgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactgaagacaatgggaaagaaaataaaactccctcctctgatgcacaggataagcagtttggtacttggagactgagagtcacacctgtcgattaccttctgggagtggctgacttaactggagaattgatgcggatgtgtattaacagtgtggggaatggggacattgataccccctttgaagtgagccagtttttacgtcaggtttatgatgggttttcattcattggcaacactggaccttacgaggtttctaagaagctgtataccttgaaacaaagtttggccaaagtggagaatgcttgttatgccttgaaagtcagagggtcagaaattccaaaacatatgttggcagatgtgttttcagttaaaacagaaatgatagatcaagaagagggcatttcttagaatctaacgttactcagttactaattcttttgagaactcctaagagaccaatttgtaagacttatttagtatttcatttaactttattgtggcttttacatagaaacatattcagttgtacttgttttaaattgtatacaagctgtacataaaattagccaaatgaatcatttcttatatcttattcatgaaagtttgcatacagatgtttgcatatatgcctttttgaatttttgctggttaacctttatcatttatctttgtaatgtgaacatgcttcagagtgtaccttttgccataacctattttaatttactttttctgaagtttggagtgataatttttagtggaagcaatttgtaatttaagttggtagttatattatatatagaaaagattttttagttaaacttctggacatgagcgtcctgtttaaatttcttgttaatatcgtgccaagcctcaaaaataggcttattccatggaacaagaattaaaaatgaataagctatcaatatataatttaagtacaagtttaggctgggcgtggtggctcacgcctgtaatcccagcactttgggaggccgaggtaggcagatcacgaggtcaagagatcaagaccagcctgaccaacgtggcgaaacctcgtctctactagaaatacaaaaattagctggatatggtggtatgtgcctgtaatcccagctacttgggaggctgaggcaggagactcgcttgaacctgggaggcagaggttgcagtgagccgagattgcgccactgcactccagcctgggtaacagagcaagactccatctcaaaaaaagaaagaaagaaaaaagaaagtacaagtttataaagtattatagtgaaaaattcgcattctggctgattttaagccatttaaaatttatataaaacaaccttccataaaaatttgacaggtgcccagatgttgctttctccatttattttttgtttttttttaatcacagtaggtctgatagagaattggagctaaattataatatttttgttggtaaagttgagttatatacttgtacatacaatggaaatgcttttagtagtgattatttagcaatttttgtttttgttatattaggcatgtttggaggctttcctattctagcatttaaatttaaattttattttacttttaaataattataatgaagttttgaaatactaagttaatccagacctttagttgtcccatggtgttaataaagttgccaaagaagatgtattatgaacaattcagcaataagacaattgtcaacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagt

SEQ ID NO: 280706 - DNA, 2707 bp, Homo sapiens
ggcggccgcaatagtacgctcgcgcggcggtggcgggtggtggtccttggaccacgcggtgggcggacagcggcacggcctcccctcccctccggacgcaggccgaagtacgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactgaagacaatgggaaagaaaataaaacttcacacctgtcgattaccttctgggagtggctgacttaactggagaattgatgcggatgtgtattaacagtgtggggaatggggacattgataccccctttgaagtgagccagtttttacgtcaggtttatgatgggttttcattcattggcaacactggaccttacgaggtttctaagaagctgtataccttgaaacaaagtttggccaaagtggagaatgcttgttatgccttgaaagtcagagggtcagaaattccaaaacatatgttggcagatgtgttttcagttaaaacagaaatgatagatcaagaagagggcatttcttagaatctaacgttactcagttactaattcttttgagaactcctaagagaccaatttgtaagacttatttagtatttcatttaactttattgtggcttttacatagaaacatattcagttgtacttgttttaaattgtatacaagctgtacataaaattagccaaatgaatcatttcttatatcttattcatgaaagtttgcatacagatgtttgcatatatgcctttttgaatttttgctggttaacctttatcatttatctttgtaatgtgaacatgcttcagagtgtaccttttgccataacctattttaatttactttttctgaagtttggagtgataatttttagtggaagcaatttgtaatttaagttggtagttatattatatatagaaaagattttttagttaaacttctggacatgagcgtcctgtttaaatttcttgttaatatcgtgccaagcctcaaaaataggcttattccatggaacaagaattaaaaatgaataagctatcaatatataatttaagtacaagtttaggctgggcgtggtggctcacgcctgtaatcccagcactttgggaggccgaggtaggcagatcacgaggtcaagagatcaagaccagcctgaccaacgtggcgaaacctcgtctctactagaaatacaaaaattagctggatatggtggtatgtgcctgtaatcccagctacttgggaggctgaggcaggagactcgcttgaacctgggaggcagaggttgcagtgagccgagattgcgccactgcactccagcctgggtaacagagcaagactccatctcaaaaaaagaaagaaagaaaaaagaaagtacaagtttataaagtattatagtgaaaaattcgcattctggctgattttaagccatttaaaatttatataaaacaaccttccataaaaatttgacaggtgcccagatgttgctttctccatttattttttgtttttttttaatcacagtaggtctgatagagaattggagctaaattataatatttttgttggtaaagttgagttatatacttgtacatacaatggaaatgcttttagtagtgattatttagcaatttttgtttttgttatattaggcatgtttggaggctttcctattctagcatttaaatttaaattttattaaaattaaataatttaaatctagcatttaaatttaaataatttaagtctagcatttacttttaaataattataatgaagttttgaaatactaagttaatccagacctttagttgtcccatggtgttaataaagttgccaaagaagatgtattatgaacaattcagcaataagacaattgtcaacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagt

SEQ ID NO: 280707 - DNA, 2019 bp, Homo sapiens
ttttgtttttttaccagccctcctcccctcctctgatgcacaggataagcagtttggtacttggagactgagagtcacacctgtcgattaccttctgggagtggctgacttaactggagaattgatgcggatgtgtattaacagtgtggggaatggggacattgataccccctttgaagtgagccagtttttacgtcaggtttatgatgggttttcattcattggcaacactggaccttacgaggtttctaagaagctgtataccttgaaacaaagtttggccaaagtggagaatgcttgttatgccttgaaagtcagagggtcagaaattccaaaacatatgttggcagatgtgttttcagttaaaacagaaatgatagatcaagaagagggcatttcttagaatctaacgttactcagttactaattcttttgagaactcctaagagaccaatttgtaagacttatttagtatttcatttaactttattgtggcttttacatagaaacatattcagttgtacttgttttaaattgtatacaagctgtacataaaattagccaaatgaatcatttcttatatcttattcatgaaagtttgcatacagatgtttgcatatatgcctttttgaatttttgctggttaacctttatcatttatctttgtaatgtgaacatgcttcagagtgtaccttttgccataacctattttaatttactttttctgaagtttggagtgataatttttagtggaagcaatttgtaatttaagttggtagttatattatatatagaaaagattttttagttaaacttctggacatgagcgtcctgtttaaatttcttgttaatatcgtgccaagcctcaaaaataggcttattccatggaacaagaattaaaaatgaataagctatcaatatataatttaagtacaagtttaggctgggcgtggtggctcacgcctgtaatcccagcactttgggaggccgaggtaggcagatcacgaggtcaagagatcaagaccagcctgaccaacgtggcgaaacctcgtctctactagaaatacaaaaattagctggatatggtggtatgtgcctgtaatcccagctacttgggaggctgaggcaggagactcgcttgaacctgggaggcagaggttgcagtgagccgagattgcgccactgcactccagcctgggtaacagagcaagactccatctcaaaaaaagaaagaaagaaaaaagaaagtacaagtttataaagtattatagtgaaaaattcgcattctggctgattttaagccatttaaaatttatataaaacaaccttccataaaaatttgacaggtgcccagatgttgctttctccatttattttttgtttttttttaatcacagtaggtctgatagagaattggagctaaattataatatttttgttggtaaagttgagttatatacttgtacatacaatggaaatgcttttagtagtgattatttagcaatttttgtttttgttatattaggcatgtttggaggctttcctattctagcatttaaatttaaattttattaaaattaaataatttaaatctagcatttaaatttaaataatttaagtctagcatttacttttaaataattataatgaagttttgaaatactaagttaatccagacctttagttgtcccatggtgttaataaagttgccaaagaagatgtattatgaacaattcagcaataagacaattgtcaacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagt

SEQ ID NO: 280708 - DNA, 871 bp, Homo sapiens
ggcggccgcaatagtacgctcgcgcggcggtggcgggtggtggtccttggaccacgcggtgggcggacagcggcacggcctcccctcccctccggacgcaggccgaagtacgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggtaagtctaggtttgtttcagggtaatatatattttaaatggtgtgctacatgattaacatgtgagttgcatgaattttaagtgacacctgatgaaataataatactggcttttaaagaactgcaactttgtagtaatatagaagtaatccaaaggcaagttggctttatgttttttttaacagtgtagtgatggtcattgattgattttaataaagtatttgagaacacagattta

SEQ ID NO: 280709 - DNA, 538 bp, Homo sapiens
cagtactaggtgtagatactatggagaagctgaccatcttgttcagaaatttggaagaagagaacctcagctcaggacataaagtttcacacaatgaaatcctgctcagttttattttacaaaccaagtgttggactcacatcacgaccagcttcaccaggagcaccgttgactccaggactacccacagcaccaggaggaccacgggccccaggagggccggcaatgccaagaggaccaggttcaccctaaacaggcagagaagataaaatgacattccccttattcgatggaatgctaaccttgcccctccaaaacaaccctactcaggagattctagtttgaaggaagaaggtaaattgaatgtgaatgggtcacacaatggtaagaagtatcattagtatcatctctgccctccttctccacatgtagatggccagctttatgtaatcacgggatgttgctctgtaaaaagtgagcctcgtgtcattcagtatcccaaatgaaatgaattcaaaaagttgatatattttatgga

SEQ ID NO: 280710 - DNA, 575 bp, Homo sapiens
cagtactaggtgtagatactatggagaagctgaccatcttgttcagaaatttggaagaagagaacctcagctcaggacataaagtttcacacaatgaaatcctgctcagttttattttacaaaccaagtgttggactcacatcacgaccagcttcaccaggagcaccgttgactccaggactacccacagcaccaggaggaccacgggccccaggagggccggcaatgccaagaggaccaggttcaccctaaacaggcagagaagataaaatgacattccccttattcgatggaatgctaaccttgcccctccaaaacaaccctactcaggagattctagtttgaaggaagaagaaagaagcaactcctgtcttcctttatgaggctgtaaccaaccaaataatggaggagagactatggcaaatttctatgaggaaaaacaatgtcatgccactggtaccctggcatattggaatcagactatgtagacacaggttagtgaggtagaagggacaatgaggagtgtaagaagagggagacatctgggaggacagtaatacggtgaagcgcgttaa

SEQ ID NO: 280711 - DNA, 698 bp, Homo sapiens
tcaagactttttgtagaaactctgcaggtcagaagatttttgtatggaatgatcttctccaatcaattatttgaatctaagaggaagagaagatcatcagtggcaaatggcagtcacaggaaagcaacacccacagccggtttcacacgtgtggagagcaccctgagcctcctcctcctggtttcccgtgctctgcaagttcagagaaacttctctcacaaccaactatagaaacaatcttggaacgtacagtcttagaaatggctttttaattgcagcatatcagagtgaaaaaggacccagagatgttggaatcagacaatcctggtttcaaatcggtttcattgttcatcctcatgtgatgtttggcaagaaataaaacatttctgcgttcagtttccttgtctgtgatattacataacatattgcaaatatgctgagtgttgagaaaataatgaacaacatgcaaggagtagctgggatatggtagcagctcagtagataatgatgatgatcaatattcaccattgacaagtagctgtgaaatccacaaatggtggacataaaaggttaaccagtgaagtgctgggacaacgtagctgaagaaatattggaatgttcctgctcagattggcctcagcctgaaaactgtttacttcctgcccaaatctggggcctgtctcctcttccagcattcc

SEQ ID NO: 280712 - DNA, 766 bp, Homo sapiens
tgggttggcagccgcttgagccactgcgaggaaagcaaagtctgggccatggagatgagcctagtcctgctgttcctgatccgcactgccctttttgcaccccagggagctgctgctggaggtgtgtgatgaagtatttagtggtctagtatcatgggtcttgcaacttactttagaatgactcagtcaaaaatcttaatctggacccttttcataagatggtgccaagaacgaagaaggaagctcctgcccctcctaaagccgaagccaaagcgaaggctttgcaaggccaagaaggcagtgttgaaagatgtccacagccacaaaaaaaacaagatccacatgtcacccaccttccggcggcccaagacactgtgactccggaggcagcccaaatatccttggaagagcacccccaggagaaataagcttgaccaccatgttatcatcaagtttccgctgaccactgagtaggctgtgaagaagatagaaaacaacagcctacttgtgttcactgtggatgttaaagccaacaagcaccagatcaaacaggctgtgaagaagtttgtgacattgatgtggccaaagtcaacactctgattcagtctgatggagagaggaaggcatatgttcgactggctcctgactacgatgctttggttgttgccaccaaaattgggatcacctaaactgagtcaagctggctagttccaaatatatgtatatcttttcaccattaaaagaatcttaatctctcaaaaaactc

SEQ ID NO: 280713 - DNA, 503 bp, Homo sapiens
gccccagctgacctgatgaatatcaacatccaatgccctgtaatgaagtcatgtgtgcacatatcatcacttctgcatgcagtctcatgggaagatggggcccaagacactgtgactccggaggcagcccaaatatccttggaagagcacccccaggagaaataagcttgaccaccatgttatcatcaagtttccgctgaccactgagtaggctgtgaagaagatagaaaacaacagcctacttgtgttcactgtggatgttaaagccaacaagcaccagatcaaacaggctgtgaagaagtttgtgacattgatgtggccaaagtcaacactctgattcagtctgatggagagaggaaggcatatgttcgactggctcctgactacgatgctttggttgttgccaccaaaattgggatcacctaaactgagtcaagctggctagttccaaatatatgtatatcttttcaccattaaaagaatcttaatctctcaaaaaactc

SEQ ID NO: 280714 - DNA, 583 bp, Homo sapiens
tgggttggcagccgcttgagccactgcgaggaaagcaaagtctgggccatggagatgagcctagtcctgctgttcctgatccgcactgccctttttgcaccccagggagctgctgctgctgggatttcagtctctggtgtcaactcctgggtctactggctccactgagggcagctacactctgcagccagatggccagaattcaactccctgcccaggtctcaccagcactttcccacttggtgcctcagtttcctcatctatgaaatggggaaactaacagcatttatttcttgtggttgggtggatgaaaagcgttagtatatatgaggggtttgcagctgtgccacattatttttgttatcatttgattatattttaatatattacatatgcggtcattgtattattattataaatgagatttatgagtgagtgtcctggttacggctccttctggggagcccaggaccagctttcctggcaccttgaggtcccctcaccctgtcacactctcatgcattacctcatatctactatgtcttcataattttatactatagaaatttaccctttaagtaga

SEQ ID NO: 280715 - DNA, 361 bp, Homo sapiens
tgggttggcagccgcttgagccactgcgaggaaagcaaagtctgggccatggagatgagcctagtcctgctgttcctgatccgcactgccctttttgcaccccagggagctgctgctgagacatggtctccctctgttatccacggtgaagtgcagtggcatgatcatggttccctgcaacctcaaactcctggcctctagaggtccccctgcctcagtgtctggagtacctgggactacaggatgctgactcctgcgtccatctcaacctgggcatcgtgccaccaccttcaagaagaagaaaaactaagtagtgctttgcaaaggggcagcagcatttctcaaatttttttttttgtca

SEQ ID NO: 280716 - DNA, 707 bp, Homo sapiens
tgggttggcagccgcttgagccactgcgaggaaagcaaagtctgggccatggagatgagcctagtcctgctgttcctgatccgcactgccctttttgcaccccagggagctgctgctgagccccacagtctttgttacaacctcacggtgctgtcccaggatggatctgtgcagtcagggtttctcgctgagggacatctggatggtcagctcttcctgctctgtgacaggcagaaaggcagggcagggccccggggacagtgggcagaagcagtcctgggagctgagacctgggacacagagactgaagacttgacagagaatgggcaggagctcaggaggaccctggctcatatcaagggccagaaaggaggcagactacatgcaaaagctatggtgatatctgaaattctggaggtatcagaaaaacagtgaatgagatgcacagtggggccttagaaggcaatgtcaccatgatgtgctggcctccatcttctatccctggaatatctctctgacctggcatcaggatgaggcatctttgagccaggatgcccagcagtctaggggtgtcctgcccaatgggaatgggacctaccagacctgcatggccaccaggattccccgaggagaggagcagaggttcacctgctacatgggacacagagggaatcacagcactcaccctgtgccctctggtgagcctg

SEQ ID NO: 280717 - DNA, 368 bp, Homo sapiens
acactggctttaaacaacacccatttattgtatttatttatttatttttagagacatggtctccctctgttatccacggtgaagtgcagtggcatgatcatggttccctgcaacctcaaactcctggcctctagaggtccccctgcctcagtgtctggagtacctgggactacaggcaagtaccaccgtgctcaggtaaattaaaaaaaaaaaaaattcctttttgtagagaggaaggtctcctcaaattgcccaggctagtctcactcctggctgcaagtaatcctcctgtgtcattcccacaaaccttaggattacaggcatgagctaccatggttgaccaaacaacacttatttatttatttaca

SEQ ID NO: 280718 - DNA, 119 bp, Homo sapiens
tgagacctgggacacagagactgaagacttgacagagaatgggcaggagctcaggaggaccctggctcatatcaagggccagaaaggaggtgagagtgggcagtgggcaagagtaatgg

SEQ ID NO: 280719 - DNA, 3058 bp, Homo sapiens
gggcgctcgcattccccgcgcggagccgaagcagccgcaacgagccgggagctgagccgcgctgcgctgcggtgcgaagagccgggcggcggccagagccctccccgcgctgccagtgggacgcggagccaggatccccggctttgccccggggctggggtgcaacagactcttaacttggtcctcgcgccccgccaaccgcccccgggcaggaaacgcccagaaccaccaccgcgccgcgctccacaaaagccccgggagttccaagacgggagggatcgggcgcgctccagaggcaggagggtcccccacaccctcaggctcatgcccagctcccccatcgggcagcccccagccccatgaggaccctcaggccggggcgagagcccggcacagcccggaccgaaattttgccgctgccttagagcgttagacaggctaggtgtggagccgccctccgcagcccaccccggcccaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagtccggttctccaccgagggacatgaggctgctttcactatccgcataagacacccgcccaaccctcggctgtacccacctgggtctctaccccagggagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaagggctggttcgcaggccggaacctggccgtgtctcaagtaaccaccaagtacgtgctgtgggtggacgacgacttcgtcttcacggcgcggacgcggctggagaggcttgtggacgtgctggagcggacgccgctggacctggtggggggcgcggtgcgcgagatctccggctttgccaccacttatcggcagctgctgagcgtggagcccggcgccccaggcctcgggaactgcctccggcaaaggcgcggcttccaccacgagctcgtcggcttcccaggctgcgtggtcaccgacggcgtggttaacttcttcctggcgcggactgacaaggtgcgcgaggtcggtttcgacccccgcctcagccgcgtggctcatctggaattcttcttggatgggcttggttcccttcgggttggctcctgctccgacgtcgtggtggatcatgcatccaaactgaagctgccttggacatcaagggatgccggagcagagacttacgcccggtaccgttacccaggatcactggacgagagccagatggccaaacaccggctgctcttcttcaaacaccggctgcagtgcatgacctcccagtgatggcccgctggggatttctgactgtcaggctgggcctgcctccttgtccctgccaggaatttccaacaaaccccaccaccctgtgagcactctactggctgtccctgagcctctagttcctcactcttccttttcagaacctgatgcccagtaggggttgtcctggtgacacccctcctttttccagtgcccagaggcctggtggagccataacctctcccacagccagtgccaagtcctccccctgcccattctcatggggcaggaaatggggggatcactttccaagtgccaaagagcccagagggactctaagaacctaaggtggaaacactgtcctctcatcttgggaccgagggggtggggaagttccccaacacataatcccaagactgtgcccctcatctgcatcttcagatccagtactctgtgtacctgctccagccccacccccacagagagaacttgtggctctggggctggggtgagggctggtggttggtgaaagccattcttagttgtgtctctgcaatgctgtgggcacaaaagaaggggcaccagagtccctgtgcaaacacctagactcacttcatggattccaaagctctcagcttcattttattagttacgttaggtaagggggttcaagggtcatggtcctcatcacacacatgtcatcagggccctcctgcactccacatgatgaggtcagacccacacggtgcaaatctttgggtcagtgagctcctggagaagagaggagacatgtcaggaatagattaggcacccctcttccttaatgaaatgtggcagtcctctcaggggtaccccacctacttagggatctgagttcttcagttcctcacccatagctcagcccgggctccctgatttggtcttcaatctactattcattccgtccccacccttttcttcttgatcttcctcagaccctttcccaaacccctctccctggg

SEQ ID NO: 280720 - DNA, 1687 bp, Homo sapiens
gggcgctcgcattccccgcgcggagccgaagcagccgcaacgagccgggagctgagccgcgctgcgctgcggtgcgaagagccgggcggcggccagagccctccccgcgctgccagtgggacgcggagccaggatccccggctttgccccggggctggggtgcaacagactcttaacttggtcctcgcgccccgccaaccgcccccgggcaggaaacgcccagaaccaccaccgcgccgcgctccacaaaagccccgggagttccaagacgggagggatcgggcgcgctccagaggcaggagggtcccccacaccctcaggctcatgcccagctcccccatcgggcagcccccagccccatgaggaccctcaggccggggcgagagcccggcacagcccggaccgaaattttgccgctgccttagagcgttagacaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagtccggttctccaccgagggacatgaggctgctttcactatccgcataagacacccgcccaaccctcggctgtacccacctgggtctctaccccagggagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaaggtgtgcagctagcaggctgaacggcaggccagaggactcccgcagggggtgtgccctcaatctgcagcctccagggtagtgattcgaggaccacctgcctcagaatcatggggtgcctgttaagcatgaggattcctggaatgtaagcttcgtgggagcaggaaattctctctgaattcttagaatggtgcttagtgcctaatggcattcaataaaatagctgatgaatgaataaataaatgcacac

SEQ ID NO: 280721 - DNA, 3017 bp, Homo sapiens
gggcgctcgcattccccgcgcggagccgaagcagccgcaacgagccgggagctgagccgcgctgcgctgcggtgcgaagagccgggcggcggccagagccctccccgcgctgccagtgggacgcggagccaggatccccggctttgccccggggctggggtgcaacagactcttaacttggtcctcgcgccccgccaaccgcccccgggcaggaaacgcccagaaccaccaccgcgccgcgctccacaaaagccccgggagttccaagacgggagggatcgggcgcgctccagaggcaggagggtcccccacaccctcaggctcatgcccagctcccccatcgggcagcccccagccccatgaggaccctcaggccggggcgagagcccggcacagcccggaccgaaattttgccgctgccttagagcgttagacaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagtccggttctccaccgagggacatgaggctgctttcactatccgcataagacacccgcccaaccctcggctgtacccacctgggtctctaccccagggagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaagggctggttcgcaggccggaacctggccgtgtctcaagtaaccaccaagtacgtgctgtgggtggacgacgacttcgtcttcacggcgcggacgcggctggagaggcttgtggacgtgctggagcggacgccgctggacctggtggggggcgcggtgcgcgagatctccggctttgccaccacttatcggcagctgctgagcgtggagcccggcgccccaggcctcgggaactgcctccggcaaaggcgcggcttccaccacgagctcgtcggcttcccaggctgcgtggtcaccgacggcgtggttaacttcttcctggcgcggactgacaaggtgcgcgaggtcggtttcgacccccgcctcagccgcgtggctcatctggaattcttcttggatgggcttggttcccttcgggttggctcctgctccgacgtcgtggtggatcatgcatccaaactgaagctgccttggacatcaagggatgccggagcagagacttacgcccggtaccgttacccaggatcactggacgagagccagatggccaaacaccggctgctcttcttcaaacaccggctgcagtgcatgacctcccagtgatggcccgctggggatttctgactgtcaggctgggcctgcctccttgtccctgccaggaatttccaacaaaccccaccaccctgtgagcactctactggctgtccctgagcctctagttcctcactcttccttttcagaacctgatgcccagtaggggttgtcctggtgacacccctcctttttccagtgcccagaggcctggtggagccataacctctcccacagccagtgccaagtcctccccctgcccattctcatggggcaggaaatggggggatcactttccaagtgccaaagagcccagagggactctaagaacctaaggtggaaacactgtcctctcatcttgggaccgagggggtggggaagttccccaacacataatcccaagactgtgcccctcatctgcatcttcagatccagtactctgtgtacctgctccagccccacccccacagagagaacttgtggctctggggctggggtgagggctggtggttggtgaaagccattcttagttgtgtctctgcaatgctgtgggcacaaaagaaggggcaccagagtccctgtgcaaacacctagactcacttcatggattccaaagctctcagcttcattttattagttacgttaggtaagggggttcaagggtcatggtcctcatcacacacatgtcatcagggccctcctgcactccacatgatgaggtcagacccacacggtgcaaatctttgggtcagtgagctcctggagaagagaggagacatgtcaggaatagattaggcacccctcttccttaatgaaatgtggcagtcctctcaggggtaccccacctacttagggatctgagttcttcagttcctcacccatagctcagcccgggctccctgatttggtcttcaatctactattcattccgtccccacccttttcttcttgatcttcctcagaccctttcccaaacccctctccctggg

SEQ ID NO: 280722 - DNA, 1982 bp, Homo sapiens
gggcgctcgcattccccgcgcggagccgaagcagccgcaacgagccgggagctgagccgcgctgcgctgcggtgcgaagagccgggcggcggccagagccctccccgcgctgccagtgggacgcggagccaggatccccggctttgccccggggctggggtgcaacagactcttaacttggtcctcgcgccccgccaaccgcccccgggcaggaaacgcccagaaccaccaccgcgccgcgctccacaaaagccccgggagttccaagacgggagggatcgggcgcgctccagaggcaggagggtcccccacaccctcaggctcatgcccagctcccccatcgggcagcccccagccccatgaggaccctcaggccggggcgagagcccggcacagcccggaccgaaattttgccgctgccttagagcgttagacaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacaggtgcaaggcctgggtggagagacgggcaggctgggcaaacagagaagaaccagaaaggctggagtgggcaaatggcagagggcatgggaggcatctgggctatggccagagctgtccagccacacaatgggtgcttcaactggaccagcagggccagagggagaacagggggcctttgttcatctggggctggagcaggccagagggaaaacccgagccttgggtgtgtctcccctttaggccaactgtggcggggccccaggaagagacttgtctaaggagttagaagactatattcccaacccaccccttactagagggcaaaggtctttactttcctgagatcccatttctcttccagcaaaagaggcctaaaagccctctttgcttctccccaaagctggtttgttgcactaagtttgcttccaccttagggcctttgcactttctattttctcagcctggaatgctcttccccagatttttgcagactggcttcttcttgtcatttagatctcagttcaaatgcctcctcttcactatcacattacttgtttgtcttattttccactcaatacttaccagtatctgaattttttaatttacttagcctggcaccagactgactaggttgctatcagttttgttgcttaatagttgtgtaaatgtggcaagttacttttctgtgtctcagcttttttttctgttgtaggaatctacttaatagggctatcatggggataaaatgagtgcatatatttaaggtaattttttaacgggtctggcacatagtaagtgctcaataaagattagcttttacttaaaattttct

SEQ ID NO: 280723 - DNA, 716 bp, Homo sapiens
gtgctttcctgaaacaaacccccttcttgcctgggtaccagactgcctttgtaggctaacaaattagctgcaagactagaaattacagtttaggcagctagaggcttccccaattgctcctagggataacacactgtaaagcctaagatttgtgtgatttttttttttcagaccctgcactgatggatccgctggtgccacccagatcaataaactggctcatctgatcttgtggcccccatccaggaaccaactcagagcaagaagacagcttcaactccctatgccttcatctctgatacgacctgtcaacacgccccactccctggccccctacctgccaaattatccttaaaaaaactcccatccctaaattttccgggagaatgatttgagtagttaactctggtctctcgttctggctctgcatgaattaaactctttctctattgcaattcctgtctagataaatcggctctatctggacagcaggcaaaatgagcctgttgggtagtcacaatatattgataaaaggattaatcccaaagcaatgttctgattatgtcacctaattatggtcacatcatctgacgtttgaggaaactgattttcgggcaggatccccaggagttggagaccaatctgggcagtaaagtgagacccctctctacagaaacaaaaaaaaggtcctacatgggagcatcacttgagcccac

SEQ ID NO: 280724 - DNA, 712 bp, Homo sapiens
aggtaaagggggcccatgggtctatcagataacctgaacccgagacctctcaatctggaggaacagcttgaagaagtcatctagaagctataaagtcacagaagcttcttatcctattgaaagcaagacttcctatccaatggcaatacaaacttttacgcagtaagaccctgcactgatggatccgctggtgccacccagatcaataaactggctcatctgatcttgtggcccccatccaggaaccaactcagagcaagaagacagcttcaactccctatgccttcatctctgatacgacctgtcaacacgccccactccctggccccctacctgccaaattatccttaaaaaaactcccatccctaaattttccgggagaatgatttgagtagttaactctggtctctcgttctggctctgcatgaattaaactctttctctattgcaattcctgtctagataaatcggctctatctggacagcaggcaaaatgagcctgttgggtagtcacaatatattgataaaaggattaatcccaaagcaatgttctgattatgtcacctaattatggtcacatcatctgacgtttgaggaaactgattttcgggcaggatccccaggagttggagaccaatctgggcagtaaagtgagacccctctctacagaaacaaaaaaaaggtcctacatgggagcatcacttgagcccac

SEQ ID NO: 280725 - DNA, 529 bp, Homo sapiens
gcaccaaggatggagatgctccaggggctgctgctgttgctgctgctgagcatgggcggggcatgggcatccagggagccgcttcggccatggtgccaccccatcaatgccatcctggctgtcgagaaggagggctgcccagtgtgcatcaccgtcaacaccaccatctgtgccggctactgccccaccatgatgcgcgtgctgcaggcggtcctgccgcccctgcctcaggtggtgtgcacctaccgtgatgtgcgcttcgagtccatccggctccctggctgcccgcgtggtgtggaccccgtggtctccttccctgtggctctcagctgtcgctgtggaccctgccgccgcagcacctctgactgtgggggtcccaaagaccaccccttgacctgtgaccacccccaactctcaggcctcctcttcctctaaagaccctccccgcagccttccaagtccatcccgactcctggagccctgacaccccgatcctcccacaataaaggcttctcaatccgcaaaaaga

SEQ ID NO: 280726 - DNA, 388 bp, Homo sapiens
gcaccaaggatggagatgctccaggggctgctgctgttgctgctgctgagcatgggcggggcatgggcatccagggagccgcttcggccatggtgccaccccatcaatgccatcctggctgtcgagaaggagggctgcccagtgtgcatcaccgtcaacaccaccatctgtgccggctactgccccaccatgatgcgcgtgctgcaggcggtcctgccgcccctgcctcaggtggtgtgcacctaccgtgatgtgcgcttcgagtccatccggctccctggctgcccgcgtggtgtggacccattagattgcttccgatgatgctctcagctgagaatagaaaacactcctgccgtagcggctatctctgaaggtggacaagagaggg

SEQ ID NO: 280727 - DNA, 1851 bp, Homo sapiens
  misc_feature (393)..(393): n is a, c, g, or t
  misc_feature (1036)..(1036): n is a, c, g, or t
acttatagcacctttattcataattgctaaaacttggaagcagccaagatgtctttcagtaggtgaatggataaagtgtggtacatccagacaatgcaatatttttcagcactaaaacaaaatgagctactaaaccatgaaaaggcatggaaggacccaaaacttattttagaattatagaaagccccatatcttattcaataaaagttattcctatttttaaaaacccatacagtatacatttggaaaatctgaatatcaattatatgttaaacaatgatagtgttgtataaatgttaaattttctgaatgttataattagatttttgcagtgtaggagccagtccttgttcttatgaggataaacactgaaatattgagagacaaaatgcnatgatgtcaccaacttattggtgtagcaaagaggcttggcaataacatcatccccccaaatatatatagaaattggcaaagtaactaatggtgattctaagtatttgtattattctaacttttctttaggtataatttttttcaaaggagttgcggaggttaccgtagatgttgtaggctatttgtccatgtcaaattagctaccgatccactagaatgattataagcaaaaagaccgacaataccaagtgttggtgaggatgtggggaaattggaaccctcttacaatgtaaaatgtaaacaggttggtagttcctcaaaatgcagagtagagttaaccataatacccagcaatttcatttctggttctataacccaaagaaatgagaagatatgtccacacacaaaaacttgaatgtgaatgttcatagcagtgttattcataattgctagcagctagcaaatgtccatctactggtaaatgcatagacaaaatatgacgtatccatatgatggagtattattcagcagtaaaatgtaataaacaacttaaacatggcacagcatagatgaatctcaaacaccttattgctaagtgaaaagacaaaagattaagttgtagaattccatttatgtttggtgntaggtaaggtaaatctgttgaaacagagccgtgtttgcccggggccagcaggtggggagtgattgccagtgtgcacaaaggagctgtttaaggtgatgaaaatgttctactttaaagtgatgattgtacaactctgtaaatttactaaaaaaatcaccgaactgtgtatgtacatacattgagtgtgtttcatggtattgtaagcaaaatcttagtaattaaaaggctcttggtttagctctgggtaagatttgaagcagtattaagactccttctgcttttcggggtcctcttaggggcttacggtgagacatatcctgccattgaagatgacgtcctccctccaccatcacagttgccctctgcacgggagcgcaggaggaacaaatggaaaggactagacattgtatgtatgagacttttctcccccttttcaacttagaagaatgagaggtctgggttctgacctgtgctaaatctgtgtggcccaataaagagcacttgcttgaaattcagacatgggtctgaatctaggctctgccttgactggatgaccttgggtagctattgaattctgctgctttggcttcttccagataataatagtattttcttgtctcctggggtggctgtaagtagctcctcatcccaaccttccttcttctcctgcagaatatatggatttcagagaggcacaagaaggaactgatgtcatttattgaaaagcttcataataacctaattctgtgatataggcatcaccttcatttcggtcaaatgacttgccaaggtcacatgggcaagaaggctgagat

SEQ ID NO: 280728 - DNA, 1032 bp, Homo sapiens
ttttgtagcgagggggtcttgctttataggccaggctggtattgaactcctgatttcaagcagtcctcctgtctgcctcccaaagtgctgggattacaagtgtgagccacagcacctgtcctagagtaattttttaataatatgatgtggtgaaaaagaccaaatttcttttacagtgaattagatgtgaactcacctatttttcctgtgaagcacatattatgatttgtcatttatctataggaaaaaggaaaggaatcccatggatatatttgatatggctagacatcggttgcaagctcctgtcagaagacagtcccctaagggcttagacgctgccacttttcagaatgttcatgattttaatgagctgaaagatagaggtgagtagattgctgctcttttaaagatgtagcagaagtgttctacccatatttaaatatctataaagatctttgtaccctttttctaaagtggaattttatctatggtatgtattttagttaaaatgaaatgaaacttatgtattctctaggtcttcagttaaccagtctggtagatgaagctttagtttgactaactgctttcttttggagagcatacagtgttaaagtctggaatggatgagatcgcatagactagtacgaagaatggaacttggcatttaatggaggatggacagacaaagatgagctcatgaaaaatactgaggagaagccagagagactggaggagaagcaggagaatgtaggatcctgaaacctgaggggaaggagtatcaaggagacaggatcatgtaaggtgaataccggaaaatgtcagttggatgaggtcattggtgacctcagctagagctttttaagtggaatgattgccgattaactttggaatgaggattgactaggaggcaagatgttggagacaataggcataagacttttagaagacccttggctgggaaagggaagggaaggagagggatcaggagctggaagagtccttagaatgtgaacgtgaggagctatgcaggag

SEQ ID NO: 280729 - DNA, 371 bp, Homo sapiens
ttctgttgctatcaccgtcttcgtaggaattgtgtgtgttaaggctttccagtattttctgagcattggaatgtagtcagtcctacctctacccatcctctgcttttagggagaacagtgtggaaacttgtgcctcttcttagtataaatttgttgtttttgtacacaaaactaataaaaatagtcattgaaacatgtttcttttagcccagagatgacactagtgatttcttgaaaaactcattattggaatctgatagtgcttttattggtgagtatatttattttattaaggctatattgtttaaatattaaacctttctccacacttaaaaaccagtactgtattccttgttgtacaaggtagtaaa

SEQ ID NO: 280730 - DNA, 3745 bp, Homo sapiens
gatgcacacggaacaaacgagggaatatgcctcctatggaacatgatggggatgttatagaacagtcaaacataagaatttcatctgctgaaaataaaagtgctccagacaatgaaacatccaaatctgctaatcaagatacctgtagtccttttgcagggatgctctttggaggtgaagatcgagaacttattcagagaaggaaagagaaatacagactagaactgttggaacaaatggctgagcaacagaggaacaagagacgagaaaaagatttagaactcagggttgcagcgtctggagcacaagaccctgagaaatcgcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtgaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataactgatttgaataggatgcacagacaaaatatagatgcctaccataacccagatgcaagaacatatgaagataaaagggctgttgtatctctagacccaaatttagccacttcaaatgctgagaacctagaagatgctgcaaataaaagctcaggtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagacaaaaagaagcagaaagaaagaagaaagaagaagaagaaaaatataacctgcaacttcagcactactgtgaaagagacaatttgattggggaagaaacaaagcacatgagacagccttctcctatagttcctgctcttcagaacaaaattgcaagcaaactccaaagacctccttcagttgacagcatcatacgttcctttattcatgaaagttccatgtccagggcacagtcacccccggtacctgccaggaaaaatcagctccgtgcagaagaggagaaaaaaaatgtaattatggaattatcagaaatgagaaaacagcttcgtagtgaagagaggcgtctacaagagcgattgctacacatggacagtgatgatgaaattcctatcaggaaaaaggaaaggaatcccatggatatatttgatatggctagacatcggttgcaagctcctgtcagaagacagtcccctaagggcttagacgctgccacttttcagaatgttcatgattttaatgagctgaaagatagagattcagaaacacgagttgatctgaaatttatgtacctggatcctccaagagatcatcacaccttagagattcagcagcaagccctgctaagagagcagcagaagaggctgaacagaataaaaatgcaggaaggtgccaaagttgacttagatgccatcccaagtgctaaagtacgagagcaaagaatgcccagagatgacactagtgatttcttgaaaaactcattattggaatctgatagtgcttttattggggcttacggtgagacatatcctgccattgaagatgacgtcctccctccaccatcacagttgccctctgcacgggagcgcaggaggaacaaatggaaaggactagacattgatagcagtcgtcctaatgtagcaccagatggtctctctctaaaatctatatccagtgtaaatgttgatgagcttagagtgagaaatgaggaacgaatgcgaagactgaatgaatttcacaataaacctattaatacagatgatgagagttcactggttgaccctgatgacatcatgaaacacataggggatgacggatcaaactctgtagcaactgagccctggctccgccctggcacttcagaaacgctgaaacgtttcatggcagagcagctgaaccaggagcagcagcagattcctggaaaaccaggcactttcacttggcagggcctgtcgactgcacatggttaaaataaacctgtactggacccagtagtgccttttaaggtgaaaggaatggtaaatctgtacctttaatatgtcctacttttggcccctacctgaaagttactttttttccatcatctgtatataaaattatttttatcatgatgtatattatgtacataaataaaaggccatgattattgatttatataatagaattgtatagattatttttgcacagttttgtcataaattagggtggtaatgaactggattgaactactatatgtgcattatattgaattctgcttgtcattaagataaggtgaataagtgtcttaaacgtcctgtaaaaccggactcccctttgttacatgcacattttccattgttacctcgatgcaaaagaattcatttagtaggtacatctattgtagctgtgattattccagtttctgtgtgatgcaatcaaatgtcctattaattaattattatttcatgtcatttgtagctactgatacagcagaaatgaagggaactgtaattacttgtatttttgtaagccatacgttaaatgtttgttacatcatctttctgcttctatttttatgccaatgaaggcatttgtcttgttactaattacatgatgtaactacttcttgatataaataaatttttattttaattactaaaatctttttaactactatggagctttctagactagttttctagaggttgaatagaggtggggacacccgggagtcaaggacagagagactggagtcttcttcttccaccatggaaccttggataagtgagtccatgtgagttttctaatcactcagtaagtgatacttctaaaaaaggaaagagtcattcaaataattgtgacattctgactcagattagaatctcagaaccatgacagctgagaacatccccaggcactgcttctctctctaataatacttcctctgatgtaattaacggttggtagacaatatcagacaaatttgccacaattaaattactgatattttgaaaattgg

SEQ ID NO: 280731 - DNA, 3542 bp, Homo sapiens
tatgaaagtgattttgatagaagactttcgagagtgtatacaaatgacagtgctccagacaatgaaacatccaaatctgctaatcaagatacctgtagtccttttgcagggatgctctttggaggtgaagatcgagaacttattcagagaaggaaagagaaatacagactagaactgttggaacaaatggctgagcaacagaggaacaagagacgagaaaaagatttagaactcagggttgcagcgtctggagcacaagaccctgagaaatcgcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtgaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataagtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagacaaaaagaagcagaaagaaagaagaaagaagaagaagaaaaatataacctgcaacttcagcactactgtgaaagagacaatttgattggggaagaaacaaagcacatgagacagccttctcctatagttcctgctcttcagaacaaaattgcaagcaaactccaaagacctccttcagttgacagcatcatacgttcctttattcatgaaagttccatgtccagggcacagtcacccccggtacctgccaggaaaaatcagctccgtgcagaagaggagaaaaaaaatgtaattatggaattatcagaaatgagaaaacagcttcgtagtgaagagaggcgtctacaagagcgattgctacacatggacagtgatgatgaaattcctatcaggaaaaaggaaaggaatcccatggatatatttgatatggctagacatcggttgcaagctcctgtcagaagacagtcccctaagggcttagacgctgccacttttcagaatgttcatgattttaatgagctgaaagatagagattcagaaacacgagttgatctgaaatttatgtacctggatcctccaagagatcatcacaccttagagattcagcagcaagccctgctaagagagcagcagaagaggctgaacagaataaaaatgcaggaaggtgccaaagttgacttagatgccatcccaagtgctaaagtacgagagcaaagaatgcccagagatgacactagtgatttcttgaaaaactcattattggaatctgatagtgcttttattggggcttacggtgagacatatcctgccattgaagatgacgtcctccctccaccatcacagttgccctctgcacgggagcgcaggaggaacaaatggaaaggactagacattgatagcagtcgtcctaatgtagcaccagatggtctctctctaaaatctatatccagtgtaaatgttgatgagcttagagtgagaaatgaggaacgaatgcgaagactgaatgaatttcacaataaacctattaatacagatgatgagagttcactggttgaccctgatgacatcatgaaacacataggggatgacggatcaaactctgtagcaactgagccctggctccgccctggcacttcagaaacgctgaaacgtttcatggcagagcagctgaaccaggagcagcagcagattcctggaaaaccaggcactttcacttggcagggcctgtcgactgcacatggttaaaataaacctgtactggacccagtagtgccttttaaggtgaaaggaatggtaaatctgtacctttaatatgtcctacttttggcccctacctgaaagttactttttttccatcatctgtatataaaattatttttatcatgatgtatattatgtacataaataaaaggccatgattattgatttatataatagaattgtatagattatttttgcacagttttgtcataaattagggtggtaatgaactggattgaactactatatgtgcattatattgaattctgcttgtcattaagataaggtgaataagtgtcttaaacgtcctgtaaaaccggactcccctttgttacatgcacattttccattgttacctcgatgcaaaagaattcatttagtaggtacatctattgtagctgtgattattccagtttctgtgtgatgcaatcaaatgtcctattaattaattattatttcatgtcatttgtagctactgatacagcagaaatgaagggaactgtaattacttgtatttttgtaagccatacgttaaatgtttgttacatcatctttctgcttctatttttatgccaatgaaggcatttgtcttgttactaattacatgatgtaactacttcttgatataaataaatttttattttaattactaaaatctttttaactactatggagctttctagactagttttctagaggttgaatagaggtggggacacccgggagtcaaggacagagagactggagtcttcttcttccaccatggaaccttggataagtgagtccatgtgagttttctaatcactcagtaagtgatacttctaaaaaaggaaagagtcattcaaataattgtgacattctgactcagattagaatctcagaaccatgacagctgagaacatccccaggcactgcttctctctctaataatacttcctctgatgtaattaacggttggtagacaatatcagacaaatttgccacaattaaattactgatattttgaaaattgg

SEQ ID NO: 280732 - DNA, 3721 bp, Homo sapiens
tatgaaagtgattttgatagaagactttcgagagtgtatacaaatgacagtgctccagacaatgaaacatccaaatctgctaatcaagatacctgtagtccttttgcagggatgctctttggaggtgaagatcgagaacttattcagagaaggaaagagaaatacagactagaactgttggaacaaatggctgagcaacagaggaacaagagacgagaaaaagatttagaactcagggttgcagcgtctggagcacaagaccctgagaaatcgcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtgaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataactgatttgaataggatgcacagacaaaatatagatgcctaccataacccagatgcaagaacatatgaagataaaagggctgttgtatctctagacccaaatttagccacttcaaatgctgagaacctagaagatgctgcaaataaaagctcaggtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagacaaaaagaagcagaaagaaagaagaaagaagaagaagaaaaatataacctgcaacttcagcactactgtgaaagagacaatttgattggggaagaaacaaagcacatgagacagccttctcctatagttcctgctcttcagaacaaaattgcaagcaaactccaaagacctccttcagttgacagcatcatacgttcctttattcatgaaagttccatgtccagggcacagtcacccccggtacctgccaggaaaaatcagctccgtgcagaagaggagaaaaaaaatgtaattatggaattatcagaaatgagaaaacagcttcgtagtgaagagaggcgtctacaagagcgattgctacacatggacagtgatgatgaaattcctatcaggaaaaaggaaaggaatcccatggatatatttgatatggctagacatcggttgcaagctcctgtcagaagacagtcccctaagggcttagacgctgccacttttcagaatgttcatgattttaatgagctgaaagatagagattcagaaacacgagttgatctgaaatttatgtacctggatcctccaagagatcatcacaccttagagattcagcagcaagccctgctaagagagcagcagaagaggctgaacagaataaaaatgcaggaaggtgccaaagttgacttagatgccatcccaagtgctaaagtacgagagcaaagaatgcccagagatgacactagtgatttcttgaaaaactcattattggaatctgatagtgcttttattggggcttacggtgagacatatcctgccattgaagatgacgtcctccctccaccatcacagttgccctctgcacgggagcgcaggaggaacaaatggaaaggactagacattgatagcagtcgtcctaatgtagcaccagatggtctctctctaaaatctatatccagtgtaaatgttgatgagcttagagtgagaaatgaggaacgaatgcgaagactgaatgaatttcacaataaacctattaatacagatgatgagagttcactggttgaccctgatgacatcatgaaacacataggggatgacggatcaaactctgtagcaactgagccctggctccgccctggcacttcagaaacgctgaaacgtttcatggcagagcagctgaaccaggagcagcagcagattcctggaaaaccaggcactttcacttggcagggcctgtcgactgcacatggttaaaataaacctgtactggacccagtagtgccttttaaggtgaaaggaatggtaaatctgtacctttaatatgtcctacttttggcccctacctgaaagttactttttttccatcatctgtatataaaattatttttatcatgatgtatattatgtacataaataaaaggccttttatttatgtacataatatacatcatgattattgatttatataatagaattgtatagattatttttgcacagttttgtcataaattagggtggtaatgaactggattgaactactatatgtgcattatattgaattctgcttgtcattaagataaggtgaataagtgtcttaaacgtcctgtaaaaccggactcccctttgttacatgcacattttccattgttacctcgatgcaaaagaattcatttagtaggtacatctattgtagctgtgattattccagtttctgtgtgatgcaatcaaatgtcctattaattaattattatttcatgtcatttgtagctactgatacagcagaaatgaagggaactgtaattacttgtatttttgtaagccatacgttaaatgtttgttacatcatctttctgcttctatttttatgccaatgaaggcatttgtcttgttactaattacatgatgtaactacttcttgatataaataaatttttattttaattactaaaatctttttaactactatggagctttctagactagttttctagaggttgaatagaggtggggacacccgggagtcaaggacagagagactggagtcttcttcttccaccatggaaccttggataagtgagtccatgtgagttttctaatcactcagtaagtgatacttctaaaaaaggaaagagtcattcaaataattgtgacattctgactcagattagaatctcagaaccatgacagctgagaacatccccaggcactgcttctctctctaataatacttcctctgatgtaattaacggttggtagacaatatcagacaaatttgccacaattaaattactgatattttgaaaattgg

SEQ ID NO: 280733 - DNA, 2603 bp, Homo sapiens
tatgaaagtgattttgatagaagactttcgagagtgtatacaaatgacagtgctccagacaatgaaacatccaaatctgctaatcaagatacctgtagtccttttgcagggatgctctttggaggtgaagatcgagaacttattcagagaaggaaagagaaatacagactagaactgttggaacaaatggctgagcaacagaggaacaagagacgagaaaaagatttagaactcagggttgcagcgtctggagcacaagaccctgagaaatcgcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtgaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataactgatttgaataggatgcacagacaaaatatagatgcctaccataacccagatgcaagaacatatgaagataaaagggctgttgtatctctagacccaaatttagccacttcaaatgctgagaacctagaagatgctgcaaataaaagctcaggtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagacaaaaagaagcagaaagaaagaagaaagaagaagaagaaaaatataacctgcaacttcagcactactgtgaaagagacaatttgattggggaagaaacaaagcacatgagacagccttctcctatagttcctgctcttcagaacaaaattgcaagcaaactccaaagacctccttcagttgacagcatcatacgttcctttattcatgaaagttccatgtccagggcacagtcacccccggtacctgccaggaaaaatcagctccgtgcagaagaggagaaaaaaaatgtaattatggaattatcagaaatgagaaaacagcttcgtagtgaagagaggcgtctacaagagcgattgctacacatggacagtgatgatgaaattcctatcaggaaaaaggaaaggaatcccatggatatatttgatatggctagacatcggttgcaagctcctgtcagaagacagtcccctaagggcttagacgctgccacttttcagaatgttcatgattttaatgagctgaaagatagaggtgagtagattgctgctcttttaaagatgtagcagaagtgttctacccatatttaaatatctataaagatctttgtaccctttttctaaagtggaattttatctatggtatgtattttagttaaaatgaaatgaaacttatgtattctctaggtcttcagttaaccagtctggtagatgaagctttagtttgactaactgctttcttttggagagcatacagtgttaaagtctggaatggatgagatcgcatagactagtacgaagaatggaacttggcatttaatggaggatggacagacaaagatgagctcatgaaaaatactgaggagaagccagagagactggaggagaagcaggagaatgtaggatcctgaaacctgaggggaaggagtatcaaggagacaggatcatgtaaggtgaataccggaaaatgtcagttggatgaggtcattggtgacctcagctagagctttttaagtggaatgattgccgattaactttggaatgaggattgactaggaggcaagatgttggagacaataggcataagacttttagaagacccttggctgggaaagggaagggaaggagagggatcaggagctggaagagtccttagaatgtgaacgtgaggagctatgcaggag

SEQ ID NO: 280734 - DNA, 607 bp, Homo sapiens
tttataatgcatttatagtaaaacttcattataacactttgttccttttaatgttgccaacatcaaatgtaaaaacaccaaactgttataagaaggtccactgtatgtggcacatgctttataagctaatgtgtttttaaggatgcacacggaacaaacgagggaatatgcctcctatggaacatgatggggatgttatagaacagtcaaacataagaatttcatctgctgaaaataaaaggtacagtatgtaatataaattctctgctttagtcattacattgtgaaacagaatgtgcctaaaactggctaactgaaaaagtagaaagatacagtaaattaacagccttccttcttagtgagaagtgaattaaaggaaaagaaaggtggggaggtagtactaaatgaaaatcgatagtactttacagcattcttttaaagaacaagttttggttataaagtgtgccaaggtgttctgaagaagtccctatcattacaaagtatgtaaatttgtttgaaataataaaagaaataagtataatttaatggactaaaaatcaacttaaaatatcttagagtcatggtgatgcaacttgactggaaataa

SEQ ID NO: 280735 - DNA, 296 bp, Homo sapiens
tgactttctgaagttctgttttctaactacaggatagcagtcgtcctaatgtagcaccagatggtctctctctaaaatctatatccagtgtaaatgttgatgagcttagagtgagaaatgaggaacgaatgcgaagactgaatgaatttcacaataaacctattaatacaggtaaatgaccaagtgtaatggcctatagtagaatcctgtatgaacttttaaactttcttactcaaggctttcactaacgtctgagggatagatggaatgagtttgaagacctttgagttgtatgg

SEQ ID NO: 280736 - DNA, 3695 bp, Homo sapiens
tatgaaagtgattttgatagaagactttcgagagtgtatacaaatgacagtgctccagacaatgaaacatccaaatctgctaatcaagatacctgtagtccttttgcagggatgctctttggaggtgaagatcgagaacttattcagagaaggaaagagaaatacagactagaactgttggaacaaatggctgagcaacagaggaacaagagacgagaaaaagatttagaactcagggttgcagcgtctggagcacaagaccctgagaaatcgcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtgaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataactgatttgaataggatgcacagacaaaatatagatgcctaccataacccagatgcaagaacatatgaagataaaagggctgttgtatctctagacccaaatttagccacttcaaatgctgagaacctagaagatgctgcaaataaaagctcaggtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagacaaaaagaagcagaaagaaagaagaaagaagaagaagaaaaatataacctgcaacttcagcactactgtgaaagagacaatttgattggggaagaaacaaagcacatgagacagccttctcctatagttcctgctcttcagaacaaaattgcaagcaaactccaaagacctccttcagttgacagcatcatacgttcctttattcatgaaagttccatgtccagggcacagtcacccccggtacctgccaggaaaaatcagctccgtgcagaagaggagaaaaaaaatgtaattatggaattatcagaaatgagaaaacagcttcgtagtgaagagaggcgtctacaagagcgattgctacacatggacagtgatgatgaaattcctatcaggaaaaaggaaaggaatcccatggatatatttgatatggctagacatcggttgcaagctcctgtcagaagacagtcccctaagggcttagacgctgccacttttcagaatgttcatgattttaatgagctgaaagatagagattcagaaacacgagttgatctgaaatttatgtacctggatcctccaagagatcatcacaccttagagattcagcagcaagccctgctaagagagcagcagaagaggctgaacagaataaaaatgcaggaaggtgccaaagttgacttagatgccatcccaagtgctaaagtacgagagcaaagaatgcccagagatgacactagtgatttcttgaaaaactcattattggaatctgatagtgcttttattggggcttacggtgagacatatcctgccattgaagatgacgtcctccctccaccatcacagttgccctctgcacgggagcgcaggaggaacaaatggaaaggactagacattgatagcagtcgtcctaatgtagcaccagatggtctctctctaaaatctatatccagtgtaaatgttgatgagcttagagtgagaaatgaggaacgaatgcgaagactgaatgaatttcacaataaacctattaatacagatgatgagagttcactggttgaccctgatgacatcatgaaacacataggggatgacggatcaaactctgtagcaactgagccctggctccgccctggcacttcagaaacgctgaaacgtttcatggcagagcagctgaaccaggagcagcagcagattcctggaaaaccaggcactttcacttggcagggcctgtcgactgcacatggttaaaataaacctgtactggacccagtagtgccttttaaggtgaaaggaatggtaaatctgtacctttaatatgtcctacttttggcccctacctgaaagttactttttttccatcatctgtatataaaattatttttatcatgatgtatattatgtacataaataaaaggccatgattattgatttatataatagaattgtatagattatttttgcacagttttgtcataaattagggtggtaatgaactggattgaactactatatgtgcattatattgaattctgcttgtcattaagataaggtgaataagtgtcttaaacgtcctgtaaaaccggactcccctttgttacatgcacattttccattgttacctcgatgcaaaagaattcatttagtaggtacatctattgtagctgtgattattccagtttctgtgtgatgcaatcaaatgtcctattaattaattattatttcatgtcatttgtagctactgatacagcagaaatgaagggaactgtaattacttgtatttttgtaagccatacgttaaatgtttgttacatcatctttctgcttctatttttatgccaatgaaggcatttgtcttgttactaattacatgatgtaactacttcttgatataaataaatttttattttaattactaaaatctttttaactactatggagctttctagactagttttctagaggttgaatagaggtggggacacccgggagtcaaggacagagagactggagtcttcttcttccaccatggaaccttggataagtgagtccatgtgagttttctaatcactcagtaagtgatacttctaaaaaaggaaagagtcattcaaataattgtgacattctgactcagattagaatctcagaaccatgacagctgagaacatccccaggcactgcttctctctctaataatacttcctctgatgtaattaacggttggtagacaatatcagacaaatttgccacaattaaattactgatattttgaaaattgg

SEQ ID NO: 280737 - DNA, 2981 bp, Homo sapiens
tatgaaagtgattttgatagaagactttcgagagtgtatacaaatgacagtgctccagacaatgaaacatccaaatctgctaatcaagatacctgtagtccttttgcagggatgctctttggaggtgaagatcgagaacttattcagagaaggaaagagaaatacagactagaactgttggaacaaatggctgagcaacagaggaacaagagacgagaaaaagatttagaactcagggttgcagcgtctggagcacaagaccctgagaaatcgcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtgaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataactgatttgaataggatgcacagacaaaatatagatgcctaccataacccagatgcaagaacatatgaagataaaagggctgttgtatctctagacccaaatttagccacttcaaatgctgagaacctagaagatgctgcaaataaaagctcaggtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagacaaaaagaagcagaaagaaagaagaaagaagaagaagaaaaatataacctgcaacttcagcactactgtgaaagagacaatttgattggggaagaaacaaagcacatgagacagccttctcctatagttcctgctcttcagaacaaaattgcaagcaaactccaaagacctccttcagttgacagcatcatacgttcctttattcatgaaagttccatgtccagggcacagtcacccccggtacctgccaggaaaaatcagctccgtgcagaagaggagaaaaaaaatgtaattatggaattatcagaaatgagaaaacagcttcgtagtgaagagaggcgtctacaagagcgattgctacacatggacagtgatgatgaaattcctatcaggaaaaaggaaaggaatcccatggatatatttgatatggctagacatcggttgcaagctcctgtcagaagacagtcccctaagggcttagacgctgccacttttcagaatgttcatgattttaatgagctgaaagatagagattcagaaacacgagttgatctgaaatttatgtacctggatcctccaagagatcatcacaccttagagattcagcagcaagccctgctaagagagcagcagaagaggctgaacagaataaaaatgcaggaaggtgccaaagttgacttagatgccatcccaagtgctaaagtacgagagcaaagaatgcccagagatgacactagtgatttcttgaaaaactcattattggaatctgatagtgcttttattggggcttacggtgagacatatcctgccattgaagatgacgtcctccctccaccatcacagttgccctctgcacgggagcgcaggaggaacaaatggaaaggactagacattgatagcagtcgtcctaatgtagcaccagatggtctctctctaaaatctatatccagtgtaaatgttgatgagcttagagtgagaaatgaggaacgaatgcgaagactgaatgaatttcacaataaacctattaatacagatgatgagagttcactggttgaccctgatgacatcatgaaacacataggggatgacggatcaaactctgtagcaactgagccctggctccgccctggcacttcagaaacgctgaaacgtttcatggcagagcagctgaaccaggagcagcagcagattcctggaaaaccaggcactttcactagatgctgcaaataaaagctcaggtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagacaaaaagaagcag

SEQ ID NO: 280738 - DNA, 1753 bp, Homo sapiens
tatgaaagtgattttgatagaagactttcgagagtgtatacaaatgacagtgctccagacaatgaaacatccaaatctgctaatcaagatacctgtagtccttttgcagggatgctctttggaggtgaagatcgagaacttattcagagaaggaaagagaaatacagactagaactgttggaacaaatggctgagcaacagaggaacaagagacgagaaaaagatttagaactcagggttgcagcgtctggagcacaagaccctgagaaatcgcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtgaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataactgatttgaataggatgcacagacaaaatatagatgcctaccataacccagatgcaagaacatatgaagataaaagggctgttgtatctctagacccaaatttagccacttcaaatgctgagaacctagaagatgctgcaaataaaagctcaggtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagacaaaaagaagcagaaagaaagaagaaagaagaagaagaaaaatataacctgcaacttcagcactactgtgaaagagacaatttgattggggaagaaacaaagcacatgagacagccttctcctatagttcctgctcttcagaacaaaattgcaagcaaactccaaagacctccttcagttgacagcatcatacgttcctttattcatgaaagttccgttgaagccgtcgacggcttcaacggaacttaacacgtgattcttctgcacacagtattgaagagcgactagattaaattctaatttacaaaattaccagttttcttcaagaact

SEQ ID NO: 280739 - DNA, 909 bp, Homo sapiens
gatgcacacggaacaaacgagggaatatgcctcctatggaacatgatggggatgttatagaacagtcaaacataagaatttcatctgctgaaaataaaagtgctccagacaatgaaacatccaaatctgctaatcaagatacctgtagtccttttgcagggatgctctttggaggtgaagatcgagaacttattcagagaaggaaagagaaatacagactagaactgttggaacaaatggctgagcaacagaggaacaagagacgagaaaaagatttagaactcagggttgcagcgtctggagcacaagaccctgagaaatcgcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtgaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaggtagataaacaacagatctgcagg

SEQ ID NO: 280740 - DNA, 2846 bp, Homo sapiens
atagccacatccctgaatgtcacctgtccctgggtgagagccatgcctgacttgtctttctttcctcttcctcttccggcgcgggcgccatgaagctgctgcggcgggcgtggcggcggcgggcggcgctaggcctgggcacgctggcgctgtgcggggcggcgctgctctacctggcgcgctgcgcggccgagcccggggaccccagggcgatgtcgggccgcagcccgcctccccccgcgcccgcgcgcgccgccgccttcctggcagtgctggtggccagcgcgccccgcgccgccgagcgccgcagcgtgatccgcagcacgtggcttgcgcggcgcggggccccgggcgacgtgtgggcgcgctttgccgtgggcacggccggcctgggcgccgaggagcggcgcgccctggagcgggagcaggcgcggcacggggacctgctgctgctgcccgcgctgcgcgacgcctacgaaaacctcacggccaaggtgctggccatgctggcctggctggacgagcacgtggccttcgagttcgtgctcaaggcggacgacgactccttcgcgcggctggacgcgctgctggccgagctgcgcgcccgcgagcccgcgcgccgccgccgcctctactggggcttcttctcgggccgcggccgcgtcaagccgggggggcgctggcgcgaggccgcctggcaactctgcgactactacctgccctacgcgctgggcggcggctacgtgctctcggccgacctggtgcactacctgcgcctcagccgcgactacctgcgcgcctggcacagcgaggacgtgtctctgggcgcctggctggcgccggtggacgtccagcgggagcacgacccgcgcttcgacaccgaataccggtcccgcggctgcagcaaccagtacctggtgacgcacaagcagagcctggaggacatgctggagaagcacgcgacgctggcgcgcgagggccgcctgtgcaagcgcgaggtgcagctgcgcctgtcctacgtgtacgactggtccgcgccgccctcgcagtgctgccagagaagggagggcatcccctgagccgccgcggcccggccctccgggacacctgcttcacccggcggcgccttggggcaggtgccgagcgggcgcactacgcccgggccccaaggcccccgtcccgcagccacgcttgtggtcgctgcgtcccggtctgcgtttgggagacccctgggggttgccggggcagcgcgccgtgtccaggtggaggtgcccgttcctggacctcagcgagcctgagccgggcccggccgcacgctgacccccgtgctgtccccgaccggctcacggggctgggctccgatcttccgtgtctcttatcagtggcgtttctcacgtctgcgtctcagatctaacgtggtttcacatcaatccgctttcatgggattttggtctctgtccagtgacttcgtggtaaatgtaactcagtgtttgcttgcgacttatttataaatattgtaagtttgtgtcgatgagtgtaagttggcagtgcgcacgtctcggtttttttacatgatttaaggaaagacttttatgtcagaacttggtgcctgtaccgtcaaccccgctgctgcccgtgtttaaacgcaggagaactttaaaactggccatctatcttttcagtgtacaagtcactgaacccattgtttctttctgaagagactttcctttcaaggcttcccatgggtccgcgccacacagggccggtgctgctttatttcagactctgccccaggttccaggaatccgaaccccggagtgctgacgcggttccccaacttccgccttaagaaaacaggaccagccggcaccaggcccgtctctcacgtactttaacacatccttgaaagcccctcgtttaatgagaaaagcgaacactgcggtccttgccaaagtaaaatgaagctgccccaggacaaggggttaccatgagctccctggagtccgacgcgggttttctctctgggggacctgggtggtccccgctgtggtctttgttgtcccactttgggaccgggtccagtctggggtctagtctcgagcatcagggtcaggctcggggcagggctgggttaggctccgggtcagtcttgccatgggtttgggagcaggtttgggttacttgcgtttgaaggcagcagtggtctcaggaggaagaaacgggggcgggagagagtggtgatctgtggtcagtgggtcagtgacctgcacggtgattctcccacctccaaaaggtaggggtgggactggaggcgtccctaggtcaggccgttgagttcgagctccgatgggccaccttgaatccaggactgaccgcccgtgtgtgcacagtttgttcttggacgaggactcgtgaggatcgagggctggggaccccggtgtgagcaggatggggccctgccctcccgtgggagttgtggactcgagcccaggggctgcccgtcacagcggtgtcccaggtccctgccatccgattttacctgggatgtcttctctggagtttggaattgcttgaggaaccctgcgtgtgcttggagaggccagagggcttgctgagaaccccatggacagtggagagcgggattcgaaccaagggctggactcccacacctctggcctgcgtcgcccagttctttgtggctctgaagaattggccgctgtggaaaagagcaaatgtccgagacccccaacaggaagagtctaaaaatccagtttgcaaccacttctgacctacaaaaaaatggaaatttagtgtttttcagcctaagacattaaatttcatatcag

SEQ ID NO: 280741 - DNA, 2818 bp, Homo sapiens
gagccggcggcgcctgcgcactcgcgagtccggcctgggccgccggcccggcgcgggcgccatgaagctgctgcggcgggcgtggcggcggcgggcggcgctaggcctgggcacgctggcgctgtgcggggcggcgctgctctacctggcgcgctgcgcggccgagcccggggaccccagggcgatgtcgggccgcagcccgcctccccccgcgcccgcgcgcgccgccgccttcctggcagtgctggtggccagcgcgccccgcgccgccgagcgccgcagcgtgatccgcagcacgtggcttgcgcggcgcggggccccgggcgacgtgtgggcgcgctttgccgtgggcacggccggcctgggcgccgaggagcggcgcgccctggagcgggagcaggcgcggcacggggacctgctgctgctgcccgcgctgcgcgacgcctacgaaaacctcacggccaaggtgctggccatgctggcctggctggacgagcacgtggccttcgagttcgtgctcaaggcggacgacgactccttcgcgcggctggacgcgctgctggccgagctgcgcgcccgcgagcccgcgcgccgccgccgcctctactggggcttcttctcgggccgcggccgcgtcaagccgggggggcgctggcgcgaggccgcctggcaactctgcgactactacctgccctacgcgctgggcggcggctacgtgctctcggccgacctggtgcactacctgcgcctcagccgcgactacctgcgcgcctggcacagcgaggacgtgtctctgggcgcctggctggcgccggtggacgtccagcgggagcacgacccgcgcttcgacaccgaataccggtcccgcggctgcagcaaccagtacctggtgacgcacaagcagagcctggaggacatgctggagaagcacgcgacgctggcgcgcgagggccgcctgtgcaagcgcgaggtgcagctgcgcctgtcctacgtgtacgactggtccgcgccgccctcgcagtgctgccagagaagggagggcatcccctgagccgccgcggcccggccctccgggacacctgcttcacccggcggcgccttggggcaggtgccgagcgggcgcactacgcccgggccccaaggcccccgtcccgcagccacgcttgtggtcgctgcgtcccggtctgcgtttgggagacccctgggggttgccggggcagcgcgccgtgtccaggtggaggtgcccgttcctggacctcagcgagcctgagccgggcccggccgcacgctgacccccgtgctgtccccgaccggctcacggggctgggctccgatcttccgtgtctcttatcagtggcgtttctcacgtctgcgtctcagatctaacgtggtttcacatcaatccgctttcatgggattttggtctctgtccagtgacttcgtggtaaatgtaactcagtgtttgcttgcgacttatttataaatattgtaagtttgtgtcgatgagtgtaagttggcagtgcgcacgtctcggtttttttacatgatttaaggaaagacttttatgtcagaacttggtgcctgtaccgtcaaccccgctgctgcccgtgtttaaacgcaggagaactttaaaactggccatctatcttttcagtgtacaagtcactgaacccattgtttctttctgaagagactttcctttcaaggcttcccatgggtccgcgccacacagggccggtgctgctttatttcagactctgccccaggttccaggaatccgaaccccggagtgctgacgcggttccccaacttccgccttaagaaaacaggaccagccggcaccaggcccgtctctcacgtactttaacacatccttgaaagcccctcgtttaatgagaaaagcgaacactgcggtccttgccaaagtaaaatgaagctgccccaggacaaggggttaccatgagctccctggagtccgacgcgggttttctctctgggggacctgggtggtccccgctgtggtctttgttgtcccactttgggaccgggtccagtctggggtctagtctcgagcatcagggtcaggctcggggcagggctgggttaggctccgggtcagtcttgccatgggtttgggagcaggtttgggttacttgcgtttgaaggcagcagtggtctcaggaggaagaaacgggggcgggagagagtggtgatctgtggtcagtgggtcagtgacctgcacggtgattctcccacctccaaaaggtaggggtgggactggaggcgtccctaggtcaggccgttgagttcgagctccgatgggccaccttgaatccaggactgaccgcccgtgtgtgcacagtttgttcttggacgaggactcgtgaggatcgagggctggggaccccggtgtgagcaggatggggccctgccctcccgtgggagttgtggactcgagcccaggggctgcccgtcacagcggtgtcccaggtccctgccatccgattttacctgggatgtcttctctggagtttggaattgcttgaggaaccctgcgtgtgcttggagaggccagagggcttgctgagaaccccatggacagtggagagcgggattcgaaccaagggctggactcccacacctctggcctgcgtcgcccagttctttgtggctctgaagaattggccgctgtggaaaagagcaaatgtccgagacccccaacaggaagagtctaaaaatccagtttgcaaccacttctgacctacaaaaaaatggaaatttagtgtttttcagcctaagacattaaatttcatatcag

SEQ ID NO: 280742 - DNA, 2846 bp, Homo sapiens
atagccacatccctgaatgtcacctgtccctgggtgagagccatgcctgacttgtctttctttcctcttcctcttccggcgcgggcgccatgaagctgctgcggcgggcgtggcggcggcgggcggcgctaggcctgggcacgctggcgctgtgcggggcggcgctgctctacctggcgcgctgcgcggccgagcccggggaccccagggcgatgtcgggccgcagcccgcctccccccgcgcccgcgcgcgccgccgccttcctggcagtgctggtggccagcgcgccccgcgccgccgagcgccgcagcgtgatccgcagcacgtggcttgcgcggcgcggggccccgggcgacgtgtgggcgcgctttgccgtgggcacggccggcctgggcgccgaggagcggcgcgccctggagcgggagcaggcgcggcacggggacctgctgctgctgcccgcgctgcgcgacgcctacgaaaacctcacggccaaggtgctggccatgctggcctggctggacgagcacgtggccttcgagttcgtgctcaaggcggacgacgactccttcgcgcggctggacgcgctgctggccgagctgcgcgcccgcgagcccgcgcgccgccgccgcctctactggggcttcttctcgggccgcggccgcgtcaagccgggggggcgctggcgcgaggccgcctggcaactctgcgactactacctgccctacgcgctgggcggcggctacgtgctctcggccgacctggtgcactacctgcgcctcagccgcgactacctgcgcgcctggcacagcgaggacgtgtctctgggcgcctggctggcgccggtggacgtccagcgggagcacgacccgcgcttcgacaccgaataccggtcccgcggctgcagcaaccagtacctggtgacgcacaagcagagcctggaggacatgctggagaagcacgcgacgctggcgcgcgagggccgcctgtgcaagcgcgaggtgcagctgcgcctgtcctacgtgtacgactggtccgcgccgccctcgcagtgctgccagagaagggagggcatcccctgagccgccgcggcccggccctccgggacacctgcttcacccggcggcgccttggggcaggtgccgagcgggcgcactacgcccgggccccaaggcccccgtcccgcagccacgcttgtggtcgctgcgtcccggtctgcgtttgggagacccctgggggttgccggggcagcgcgccgtgtccaggtggaggtgcccgttcctggacctcagcgagcctgagccgggcccggccgcacgctgacccccgtgctgtccccgaccggctcacggggctgggctccgatcttccgtgtctcttatcagtggcgtttctcacgtctgcgtctcagatctaacgtggtttcacatcaatccgctttcatgggattttggtctctgtccagtgacttcgtggtaaatgtaactcagtgtttgcttgcgacttatttataaatattgtaagtttgtgtcgatgagtgtaagttggcagtgcgcacgtctcggtttttttacatgatttaaggaaagacttttatgtcagaacttggtgcctgtaccgtcaaccccgctgctgcccgtgtttaaacgcaggagaactttaaaactggccatctatcttttcagtgtacaagtcactgaacccattgtttctttctgaagagactttcctttcaaggcttcccatgggtccgcgccacacagggccggtgctgctttatttcagactctgccccaggttccaggaatccgaaccccggagtgctgacgcggttccccaacttccgccttaagaaaacaggaccagccggcaccaggcccgtctctcacgtactttaacacatccttgaaagcccctcgtttaatgagaaaagcgaacactgcggtccttgccaaagtaaaatgaagctgccccaggacaaggggttaccatgagctccctggagtccgacgcgggttttctctctgggggacctgggtggtccccgctgtggtctttgttgtcccactttgggaccgggtccagtctggggtctagtctcgagcatcagggtcaggctcggggcagggctgggttaggctccgggtcagtcttgccatgggtttgggagcaggtttgggttacttgcgtttgaaggcagcagtggtctcaggaggaagaaacgggggcgggagagagtggtgatctgtggtcagtgggtcagtgacctgcacggtgattctcccacctccaaaaggtaggggtgggactggaggcgtccctaggtcaggccgttgagttcgagctccgatgggccaccttgaatccaggactgaccgcccgtgtgtgcacagtttgttcttggacgaggactcgtgaggatcgagggctggggaccccggtgtgagcaggatggggccctgccctcccgtgggagttgtggactcgagcccaggggctgcccgtcacagcggtgtcccaggtccctgccatccgattttacctgggatgtcttctctggagtttggaattgcttgaggaaccctgcgtgtgcttggagaggccagagggcttgctgagaaccccatggacagtggagagcgggattcgaaccaagggctggactcccacacctctggcctgcgtcgcccagttctttctccctccaacgtttcccccctccaaaagtccccctttcccgccccccccgccggatctttcccctccccttcccccctcctcctcctcccgacctacaaaaaaatggaaatttagtgtttttcagcctaagacattaaatttcatatcag

SEQ ID NO: 280743 - DNA, 2802 bp, Homo sapiens
gagccggcggcgcctgcgcactcgcgagtccggcctgggccgccggcccggcgcgggcgccatgaagctgctgcggcgggcgtggcggcggcgggcggcgctaggcctgggcacgctggcgctgtgcggggcggcgctgctctacctggcgcgctgcgcggccgagcccggggaccccagggcgatgtcgggccgcagcccgcctccccccgcgcccgcgcgcgccgccgccttcctggcagtgctggtggccagcgcgccccgcgccgccgagcgccgcagcgtgatccgcagcacgtggcttgcgcggcgcggggccccgggcgacgtgtgggcgcgctttgccgtgggcacggccggcctgggcgccgaggagcggcgcgccctggagcgggagcaggcgcggcacggggacctgctgctgctgcccgcgctgcgcgacgcctacgaaaacctcacggccaaggtgctggccatgctggcctggctggacgagcacgtggccttcgagttcgtgctcaaggcggacgacgactccttcgcgcggctggacgcgctgctggccgagctgcgcgcccgcgagcccgcgcgccgccgccgcctctactggggcttcttctcgggccgcggccgcgtcaagccgggggggcgctggcgcgaggccgcctggcaactctgcgactactacctgccctacgcgctgggcggcggctacgtgctctcggccgacctggtgcactacctgcgcctcagccgcgactacctgcgcgcctggcacagcgaggacgtgtctctgggcgcctggctggcgccggtggacgtccagcgggagcacgacccgcgcttcgacaccgaataccggtcccgcggctgcagcaaccagtacctggtgacgcacaagcagagcctggaggacatgctggagcgcgcgagggccgcctgtgcaagcgcgaggtgcagctgcgcctgtcctacgtgtacgactggtccgcgccgccctcgcagtgctgccagagaagggagggcatcccctgagccgccgcggcccggccctccgggacacctgcttcacccggcggcgccttggggcaggtgccgagcgggcgcactacgcccgggccccaaggcccccgtcccgcagccacgcttgtggtcgctgcgtcccggtctgcgtttgggagacccctgggggttgccggggcagcgcgccgtgtccaggtggaggtgcccgttcctggacctcagcgagcctgagccgggcccggccgcacgctgacccccgtgctgtccccgaccggctcacggggctgggctccgatcttccgtgtctcttatcagtggcgtttctcacgtctgcgtctcagatctaacgtggtttcacatcaatccgctttcatgggattttggtctctgtccagtgacttcgtggtaaatgtaactcagtgtttgcttgcgacttatttataaatattgtaagtttgtgtcgatgagtgtaagttggcagtgcgcacgtctcggtttttttacatgatttaaggaaagacttttatgtcagaacttggtgcctgtaccgtcaaccccgctgctgcccgtgtttaaacgcaggagaactttaaaactggccatctatcttttcagtgtacaagtcactgaacccattgtttctttctgaagagactttcctttcaaggcttcccatgggtccgcgccacacagggccggtgctgctttatttcagactctgccccaggttccaggaatccgaaccccggagtgctgacgcggttccccaacttccgccttaagaaaacaggaccagccggcaccaggcccgtctctcacgtactttaacacatccttgaaagcccctcgtttaatgagaaaagcgaacactgcggtccttgccaaagtaaaatgaagctgccccaggacaaggggttaccatgagctccctggagtccgacgcgggttttctctctgggggacctgggtggtccccgctgtggtctttgttgtcccactttgggaccgggtccagtctggggtctagtctcgagcatcagggtcaggctcggggcagggctgggttaggctccgggtcagtcttgccatgggtttgggagcaggtttgggttacttgcgtttgaaggcagcagtggtctcaggaggaagaaacgggggcgggagagagtggtgatctgtggtcagtgggtcagtgacctgcacggtgattctcccacctccaaaaggtaggggtgggactggaggcgtccctaggtcaggccgttgagttcgagctccgatgggccaccttgaatccaggactgaccgcccgtgtgtgcacagtttgttcttggacgaggactcgtgaggatcgagggctggggaccccggtgtgagcaggatggggccctgccctcccgtgggagttgtggactcgagcccaggggctgcccgtcacagcggtgtcccaggtccctgccatccgattttacctgggatgtcttctctggagtttggaattgcttgaggaaccctgcgtgtgcttggagaggccagagggcttgctgagaaccccatggacagtggagagcgggattcgaaccaagggctggactcccacacctctggcctgcgtcgcccagttctttgtggctctgaagaattggccgctgtggaaaagagcaaatgtccgagacccccaacaggaagagtctaaaaatccagtttgcaaccacttctgacctacaaaaaaatggaaatttagtgtttttcagcctaagacattaaatttcatatcag

SEQ ID NO: 280744 - DNA, 755 bp, Homo sapiens
  misc_feature (32)..(33): n is a, c, g, or t
gaaactaacggctaggtacgaggcctgggtgnnggctgggttaggctccgggtcagtcttgccatgggtttgggagcaggtttgggttacttgcgtttgaaggcagcagtggtctcaggaggaagaaacgggggcgggagagagtggtgatctgtggtcagtgggtcagtgacctgcacggtgattctcccacctccaaaaggtaggggtgggactggaggcgtccctaggtcaggccgttgagttcgagctccgatgggccaccttgaatccaggactgaccgcccgtgtgtgcacagtttgttcttggacgaggactcgtgaggatcgagggctggggaccccggtgtgagcaggatggggccctgccctcccgtgggagttgtggactcgagcccaggggctgcccgtcacagcggtgtcccaggtccctgccatccgattttacctgggatgtcttctctggagtttggaattgcttgaggaaccctgcgtgtgcttggagaggccagagggcttgctgagaaccccatggacagtggagagcgggattcgaaccaagggctggactcccacacctctggcctgcgtcgcccagttctttgtggctctgaagaattggccgctgtggaaaagagcaaatgtccgagacccccaacaggaagagtctaaaaatccagtttgcaaccacttctgacctacaaaaaaatggaaatttagtgtttttcagcctaagacattaaatttcatatcag

SEQ ID NO: 280745 - DNA, 513 bp, Homo sapiens
ccgtgtgtgcacagtttgttcttggacgaggactcgtgaggatcgagggctggggaccccggtgctgctttatttcagactctgccccaggttccaggaatccgaaccccggagtgctgacgcggttccccaacttccgccttaagaaaacaggaccagccggcaccaggcccgtctctcacgtactttaacacatccgattttacctgggatgtcttctctggagtttggaattgcttgaggaaccctgcgtgtgcttggagaggccagagggcttgctgagaaccccatggacagtggagagcgggattcgaaccaagggctggactcccacacctctggcctgcgtcgcccagttctttgtggctctgaagaattggccgctgtggaaaagagcaaatgtccgagacccccaacaggaagagtctaaaaatccagtttgcaaccacttctgacctacaaaaaaatggaaatttagtgtttttcagcctaagacattaaatttcatatcag

SEQ ID NO: 280746 - DNA, 2817 bp, Homo sapiens
atagccacatccctgaatgtcacctgtccctgggtgagagccatgcctgacttgtctttctttcctcttcctcttccggcgcgggcgccatgaagctgctgcggcgggcgtggcggcggcgggcggcgctaggcctgggcacgctggcgctgtgcggggcggcgctgctctacctggcgcgctgcgcggccgagcccggggaccccagggcgatgtcgggccgcagcccgcctccccccgcgcccgcgcgcgccgccgccttcctggcagtgctggtggccagcgcgccccgcgccgccgagcgccgcagcgtgatccgcagcacgtggcttgcgcggcgcggggccccgggcgacgtgtgggcgcgctttgccgtgggcacggccggcctgggcgccgaggagcggcgcgccctggagcgggagcaggcgcggcacggggacctgctgctgctgcccgcgctgcgcgacgcctacgaaaacctcacggccaaggtgctggccatgctggcctggctggacgagcacgtggccttcgagttcgtgctcaaggcggacgacgactccttcgcgcggctggacgcgctgctggccgagctgcgcgcccgcgagcccgcgcgccgccgccgcctctactggggcttcttctcgggccgcggccgcgtcaagccgggggggcgctggcgcgaggccgcctggcaactctgcgactactacctgccctacgcgctgggcggcggctacgtgctctcggccgacctggtgcactacctgcgcctcagccgcgactacctgcgcgcctggcacagcgaggacgtgtctctgggcgcctggctggcgccggtggacgtccagcgggagcacgacccgcgcttcgacaccgaataccggtcccgcggctgcagcaaccagtacctggtgacgcacaagcagagcctggaggacatgctggagaagcacgcgacgctggcgcgcgagggccgcctgtgcaagcgcgaggtgcagctgcgcctgtcctacgtgtacgactggtccgcgccgccctcgcagtgctgccagagaagggagggcatcccctgagccgccgcggcccggccctccgggacacctgcttcacccggcggcgccttggggcaggtgccgagcgggcgcactacgcccgggccccaaggcccccgtcccgcagccacgcttgtggtcgctgcgtcccggtctgcgtttgggagacccctgggggttgccggggcagcgcgccgtgtccaggtggaggtgcccgttcctggacctcagcgagcctgagccgggcccggccgcacgctgacccccgtgctgtccccgaccggctcacggggctgggctccgatcttccgtgtctcttatcagtggcgtttctcacgtctgcgtctcagatctaacgtggtttcacatcaatccgctttcatgggattttggtctctgtccagtgacttcgtggtaaatgtaactcagtgtttgcttgcgacttatttataaatattgtaagtttgtgtcgatgagtgtaagttggcagtgcgcacgtctcggtttttttacatgatttaaggaaagacttttatgtcagaacttggtgcctgtaccgtcaaccccgctgctgcccgtgtttaaacgcaggagaactttaaaactggccatctatcttttcagtgtacaagtcactgaacccattgtttctttctgaagagactttcctttcaaggcttcccatgggtccgcgccacacagggccggtgctgctttatttcagactctgccccaggttccaggaatccgaaccccggagtgctgacgcggttccccaacttccgccttaagaaaacaggaccagccggcaccaggcccgtctctcacgtactttaacacatccttgaaagcccctcgtttaatgagaaaagcgaacactgcggtccttgccaaagtaaaatgaagctgccccaggacaaggggttaccatgagctccctggagtccgacgcgggttttctctctgggggacctgggtggtccccgctgtggtctttgttgtcccactttgggaccgggtccagtctggggtctagtctcgagcatcagggtcaggctcggggcagggctgggttaggctccgggtcagtcttgccatgggtttgggagcaggtttgggttacttgcgtttgaaggcagcagtggtctcaggaggaagaaacgggggcgggagagagtggtgatctgtggtcagtgggtcagtgacctgcacggtgattctcccacctccaaaaggtaggggtgggactggaggcgtccctaggtcaggccgttgagttcgagctccgatgggccaccttgaatccaggactgaccgcccgtgtgtgcacagtttgttcttggacgaggactcgtgaggatcgagggctggggaccccggtgtgagcaggatggggccctgccctcccgtgggagttgtggactcgagcccaggggctgcccgtcacagcggtgtcccaggtccctgccatccgattttacctgggatgtcttctctggagtttggaattgcttgaggaaccctgcgtgtgcttggagaggccagagggcttgctgagaaccccatggacagtggagagcgggattcgaaccaagggctggactcccacacctctggcctgcgtcgcccagttctttgtggctctgaagaattggccgctgtggaaaagagcaaatgtccgagacccccaacaggaagagtctaaaaatccagtttgcaaccacttctacgaccgagtatctgggggatcctcagataa

SEQ ID NO: 280747 - DNA, 2189 bp, Homo sapiens
gagccggcggcgcctgcgcactcgcgagtccggcctgggccgccggcccggcgcgggcgccatgaagctgctgcggcgggcgtggcggcggcgggcggcgctaggcctgggcacgctggcgctgtgcggggcggcgctgctctacctggcgcgctgcgcggccgagcccggggaccccagggcgatgtcgggccgcagcccgcctccccccgcgcccgcgcgcgccgccgccttcctggcagtgctggtggccagcgcgccccgcgccgccgagcgccgcagcgtgatccgcagcacgtggcttgcgcggcgcggggccccgggcgacgtgtgggcgcgctttgccgtgggcacggccggcctgggcgccgaggagcggcgcgccctggagcgggagcaggcgcggcacggggacctgctgctgctgcccgcgctgcgcgacgcctacgaaaacctcacggccaaggtgctggccatgctggcctggctggacgagcacgtggccttcgagttcgtgctcaaggcggacgacgactccttcgcgcggctggacgcgctgctggccgagctgcgcgcccgcgagcccgcgcgccgccgccgcctctactggggcttcttctcgggccgcggccgcgtcaagccgggggggcgctggcgcgaggccgcctggcaactctgcgactactacctgccctacgcgctgggcggcggctacgtgctctcggccgacctggtgcactacctgcgcctcagccgcgactacctgcgcgcctggcacagcgaggacgtgtctctgggcgcctggctggcgccggtggacgtccagcgggagcacgacccgcgcttcgacaccgaataccggtcccgcggctgcagcaaccagtacctggtgacgcacaagcagagcctggaggacatgctggagaagcacgcgacgctggcgcgcgagggccgcctgtgcaagcgcgaggtgcagctgcgcctgtcctacgtgtacgactggtccgcgccgccctcgcagtgctgccagagaagggagggcatcccctgagccgccgcggcccggccctccgggacacctgcttcacccggcggcgccttggggcaggtgccgagcgggcgcactacgcccgggccccaaggcccccgtcccgcagccacgcttgtggtcgctgcgtcccggtctgcgtttgggagacccctgggggttgccggggcagcgcgccgtgtccaggtggaggtgcccgttcctggacctcagcgagcctgagccgggcccggccgcacgctgacccccgtgctgtccccgaccggctcacggggctgggctccgatcttccgtgtctcttatcagtggcgtttctcacgtctgcgtctcagatctaacgtggtttcacatcaatccgctttcatgggattttggtctctgtccagtgacttcgtggtaaatgtaactcagtgtttgcttgcgacttatttataaatattgtaagtttgtgtcgatgagtgtaagttggcagtgcgcacgtctcggtttttttacatgatttaaggaaagacttttatgtcagaacttggtgcctgtaccgtcaaccccgctgctgcccgtgtttaaacgcaggagaactttaaaactggccatctatcttttcagtgtacaagtcactgaacccattgtttctttctgaagagactttcctttcaaggcttcccatgggtccgcgccacacagggccggtgctgctttatttcagactctgccccaggttccaggaatccgaaccccggagtgctgacgcggttccccaacttccgccttaagaaaacaggaccagccggcaccaggcccgtctctcacgtactttaacacatccgattttacctgggatgtcttctctggagtttggaattgcttgaggaaccctgcgtgtgcttggagaggccagagggcttgctgagaaccccatggacagtggagagcgggattcgaaccaagggctggactcccacacctctggcctgcgtcgcccagttctttgtggctctgaagaattggccgctgtggaaaagagcaaatgtccgagacccccaacaggaagagtctaaaaatccagtttgcaaccacttctgacctacaaaaaaatggaaatttagtgtttttcagcctaagacattaaatttcatatcag

SEQ ID NO: 280748 - DNA, 829 bp, Homo sapiens
ttctccaggtgagaaaattgaggcccaagaggttaaatgacttgctcagatcttggactgaatcctttaacccaggggtccccaaccccagggccagtaccggaccgtggcctgttaggaactgggccgcacaagagtaccaagatcaaacatcctgcctacatggggttgatatttggagcagtatacctgcagtctgcatgttggaagcccttgttcaccgggacatgaacatatattcacagaagacaacaatccctggtgggacagcttacattgggtgatgagtttccggtgctcatcgcgagagtcttccatggtgtaaagggtttgcttggtgatgctgttcaggtccacgttcctccagtcttccagcatttggaacgtgatgtctgcactgtggatcactgttcgagatgcctataatccaatccaatcaactcgttagctcatgggttgttaaaaccctttcactgtatttccttttatgccttgttaatgcatctgcttatggtattttgcaaactaccctgaaattccgggaaattcaatttcaggaaagcaccagaagactctgtaactcagaagacgcagacactgttttctcctatggttctttccacacatctctttttctctacaagaaactgcgagggtgggctaggccagaccaaaccctgctgtttccagtccctttggtcttgaccccatggaacaatgggatgaagcccagagatctgtcagctttctgatgtaagcctgtgggatgggagctctgtgctgaattatccttgtgtctccagtacctgagaagctgcaggctgggatt

SEQ ID NO: 280749 - DNA, 742 bp, Homo sapiens
gtactcaggggaaggattgctaacaggggaagagggaggtggcacttccacagatgtggcagattttgctggagaaaacgatggcactggtgaaggggttggtgcggcagcctctgtcaagatgatctcttctcggacttctgctgtggatagagatagggacaacaatccctggtgggacagcttacattgggtgatgagtttccggtgctcatcgcgagagtcttccatggtgtaaagggtttgcttggtgatgctgttcaggtccacgttcctccagtcttccagcatttggaacgtgatgtctgcactgtggatcactgttcgagatgcctataatccaatccaatcaactcgttagctcatgggttgttaaaaccctttcactgtatttccttttatgccttgttaatgcatctgcttatggtattttgcaaactaccctgaaattccgggaaattcaatttcaggaaagcaccagaagactctgtaactcagaagacgcagacactgttttctcctatggttctttccacacatctctttttctctacaagaaactgcgagggtgggctaggccagaccaaaccctgctgtttccagtccctttggtcttgaccccatggaacaatgggatgaagcccagagatctgtcagctttctgatgtaagcctgtgggatgggagctctgtgctgaattatccttgtgtctccagtacctgagaagctgcaggctgggatt

SEQ ID NO: 280750 - DNA, 637 bp, Homo sapiens
gtgcctgaatcagaaacagaaacttctagactgatgtggttcagtggtgcttacataggctattgtttactacatctgcaccaacctttcaggaagcatttggcttgtacatttagctctgtggcccactgaagagaatttcctgtgggcagtggggtgaggaaccctgccttaatctgcttctcagtcatctgtggaccacacctacaccagcgcttccttctgcgcatcctatggcacctgtctacttcctgttttgggaatccccacagaggctagcacagtgctgaacttgtaaaaattctggaggttagaagtccaagatcaaggtgccatcaggattgatttcttgtgaggcctttcttcctggcttgctgtgtcctcagatggctcttcatctgtgtatgtgcagagagaaaaagatttctctggtggccttctaaaaaaaaatcagtcttcagaggcaaagttggacatcccaaagatggcatagataaacatgaccaggaagagcaggaggccgatgttaaacaacgcaggaagggacatcatcaaagcaaagagcagcgtgcggatcccctttgctcctttgatcagacgtaggattcggccaatcctggcaagacggatcactcgg

SEQ ID NO: 280751 - DNA, 1725 bp, Homo sapiens
tctgaaatatggcattgccctcctcatcttacaggtggaaaaactgaagcttgagataagcaacctaaacagtatcacacagctaatgaggagtcaaatgcaggcctgcctgtccccaaagtccagattcttcctttcctagaatgtcagggctagggaagtgctgagaccctctggtctacccccaccccctaattttatgaaagacaaggataaagtcccagggaaacaatgtgttcaaggctacccagtgacgcatgaccccatacaggctctataaggatgttacactcggtcatctctacatgcctggtacctagcacaggatcctggtacattggaggtgcttgagtaactgtgaatacaggaacatagtcatttaatagcaaagctagagccctgtcccccaaggccagcttactgcctcccctccccctcacgcctggcatcccacctggatgtatgcatggttggtcggatgaaactcctccccaacaggattaggacactcgccctcacagcgataggcgttgtactgcttggggtagatgatccaggagccccatccgatcaggttgaagtccacctggaacttgaccttccgacacagttgacttctgtctggcaagtgatgtcgacggtgcctcttgccccactcccaggacagctgtccctcctgggcccgccaggagctctcggcttcccacagcaaggtggacccacccagctgcctctgctcctgcgagaggttggagtagagcataaggagcacattggtggcaggcggtgtggggggccgcggccagcactctccagctaccctggacatctgcttctccagggccccagggcgcttcagccacttggagagaggcctggtcacctccaaaaccatgctgcccaaggaaaaggtgacctgggacaaagtgacagtgaataggtccatctgaaaccgctctaagcagctgtctgaagcctgctctgtgtcgggctttggctggtggaaaatctcaatggcaagtgagccctcagtggggaggtccacagggctggacagctgcagccggagctcagcccatgccagatcctcttgttggctcaggaaggagaagtcaaaagcaaacgtccagttctgcccatccactgccacatctgggtaggagaaaaccaagaaggaaggagggtgagtgagggcctcccccagcctcagtcagtgtcacaaccaccatagctcttgctggaggccttaccttatatagaattaccttcgaattctcaccccaactctatgagttggtaagattttcgagtcccttttagagatgaggaaaactgaggctcagtgtggttaaaagatctgaccaaggtgtcattcttggaaggtggcagagccaagagtaaacctggatttgcccaactgccaagcccagactccgaattactgttcttccagtcccccttccaagataacttgcacagccagaggacagtcagtaaaaatgtgatgagttgcatctccccctcccctgtctcctcccatacatgaagtctggccagcatggagaaaccctgtctctactaaaaatacaaaattggctgggcgtggtggtttgcgcctgtaatcccagccactcgagaatcatttgaacccgggaggcagaggttgcagtgagccgggacagtgccattgcactccagcctgcacaacaagagtgaaactgtctc

SEQ ID NO: 280752 - DNA, 2225 bp, Homo sapiens
gtgagcgcctgagagtctttttgcctttcagagttaaggcctcactggcctgggaaaataattgctgccttttgcatccgcgttggctccgtccccaggatcttcccggttcagggacctggcgatttctgagtgttccggaatcccaataaccctgtttaaagaggaatggagattgccactgtccatttagattaatgaggtgtcctgaagtgatggtgacatcaatgaaaggagggttctgacacgttctcacctcgcgggatggcagctgctgatttgtcccatggacattatctttctggggacccagtttgccttcatgaagaaaagacaccagcaggaagaatagtggctgactgcctaacagattgttatcaggattcagtgacctttgacgatgtggctgtggacttcacccaggaggagtggactttactggactcaactcagagaagcctctacagtgacgtgatgctggagaactacaagaacctggccacagtaggaggtcagatcatcaaacccagtctaatctcttggttggaacaagaagagtcaaggacagttcagggaggagttctccaaggaaggaaaacacaatggaagggaactctgtgactgtgagcaatgtggagaagtcttcagtgaacactcatgccttaagacgcacgtgagaactcaaagtacagggaacactcatgactgtaatcagtatggaaaagatttccttaccctgtgtgagaaaacctctactggtgagaaactttctgagtttaatcagagtgaaaaaatcttcagcctgacaccaaatattgtataccagagaactagcacacaagaaaagtcatttgaatgtagtcactgtggaaaatccttcattaatgagtcataccttcaggcacatatgagaactcacaatggagaaaaactctacgaatggaggaattatgggccaggttttattgactctacaagcctttctgtgcttatagaaaccctcaatgcaaaaaagccctacaaatgtaaggaatgtggaaaaggctatagatacccagcctacctcagtattcacatgcgaacccacactggggagaaaccatatgaatgtaaggaatgtgggaaagccttcaattattccaactcatttcagatacatggaagaactcacactggagagaaaccctatgtatgtaaggaatgtgggaaagccttcactcagtactcgggccttagtatgcatgtacgatctcacagtggagacaagccctatgaatgtaaggaatgtgggaaatccttccttacatcctcacgccttattcaacatataagaactcacactggagagaagcctttgtatgtgttgaatgtgggaaagcctttgcagtttcctcaaatcttagtggacatttgagaactcacactgaagagaaggcctgtgagtgtaagatatgtgggaaagtatttgggtatccctcatgtcttaataatcacatgcgaacgcacagtgcccagaaaccatacacctgtaaggaatgtgggaaggcttttaactattccacccaccttaaaattcacatgcgaatccacactggagaaaaaccctatgagtgtaaacaatgtggaaaggccttcagtcattccagttcatttcaaatacatgaaaggactcacactggagagaaaccctatgaatgcaaggagtgtgggaaagccttcacgtgttccagttcctttagaattcatgaaaaaactcacacagaagagaaaccctataaatgtcagcaatgcgggaaagcttacagtcatccccgttcacttcgaagacatgaacaaattcactagtgagaaactgtccatgtaataaatgtgggaaagctctcatttgttccagttcactttaaagacatgaatgaactcactctggagagaagaagctgcatgaaaattacttaattcctgtaatcccagcattttgagaggctgaggtgggtggatcacttgaggtcaggagtttgagaccaccctggccaacatggtgaaaccttgtctctactgaaaatacaaaaaatttagccaggtgtggtgggcacctgtaatcccagctacttgggaggctgaggcaagtgaatcacttgaacccaggaagcagaggttgcagtgagcagagatcatgccactgcactccagcctgggcgatggagtgagactccatctcaaaaaaa

SEQ ID NO: 280753 - DNA, 1996 bp, Homo sapiens
gtgagcgcctgagagtctttttgcctttcagagttaaggcctcactggcctgggaaaataattgctgccttttgcatccgcgttggctccgtccccaggatcttcccggttcagggacctggcgatttctgagtgttccggaatcccaataaccctgtttaaagaggaatggagattgccactgtccatttagattaatgaggtgtcctgaagtgatggtgacatcaatgaaaggagggttctgacacgttctcacctcgcgggatggcagctgctgatttgtcccatggacattatctttctggggacccagtttgccttcatgaagaaaagacaccagcaggaagaatagtggctgactgcctaacagattgttatcaggattcagtgacctttgacgatgtggctgtggacttcacccaggaggagtggactttactggactcaactcagagaagcctctacagtgacgtgatgctggagaactacaagaacctggccacagtaggaggtcagatcatcaaacccagtctaatctcttggttggaacaagaagagtcaaggacagttcagggaggagttctccaaggatgggaaatgcgacttgaaacccagtggtctatacttcagcaggactttttgaggggtcagacatccattgggatacaattggaaggaaaacacaatggaagggaactctgtgactgtgagcaatgtggagaagtcttcagtgaacactcatgccttaagacgcacgtgagaactcaaagtacagggaacactcatgactgtaatcagtatggaaaagatttccttaccctgtgtgagaaaacctctactggtgagaaactttctgagtttaatcagagtgaaaaaatcttcagcctgacaccaaatattgtataccagagaactagcacacaagaaaagtcatttgaatgtagtcactgtggaaaatccttcattaatgagtcataccttcaggcacatatgagaactcacaatggagaaaaactctacgaatggaggaattatgggccaggttttattgactctacaagcctttctgtgcttatagaaaccctcaatgcaaaaaagccctacaaatgtaaggaatgtggaaaaggctatagatacccagcctacctcagtattcacatgcgaacccacactggggagaaaccatatgaatgtaaggaatgtgggaaagccttcaattattccaactcatttcagatacatggaagaactcacactggagagaaaccctatgtatgtaaggaatgtgggaaagccttcactcagtactcgggccttagtatgcatgtacgatctcacagtggagacaagccctatgaatgtaaggaatgtgggaaatccttccttacatcctcacgccttattcaacatataagaactcacactggagagaagcctttgtatgtgttgaatgtgggaaagcctttgcagtttcctcaaatcttagtggacatttgagaactcacactgaagagaaggcctgtgagtgtaagatatgtgggaaagtatttgggtatccctcatgtcttaataatcacatgcgaacgcacagtgcccagaaaccatacacctgtaaggaatgtgggaaggcttttaactattccacccaccttaaaattcacatgcgaatccacactggagaaaaaccctatgagtgtaaacaatgtggaaaggccttcagtcattccagttcatttcaaatacatgaaaggactcacactggagagaaaccctatgaatgcaaggagtgtgggaaagccttcacgtgttccagttcctttagaattcatgaaaaaactcacacagaagagaaaccctataaatgtcagcaatgcgggaaagcttacagtcatccccgttcacttcgaagacatgaacaaattcactagtgagttttcatgtccacccttatattatgtggctacgctctcatttacatccagcgcccgtttataac

SEQ ID NO: 280754 - DNA, 2308 bp, Homo sapiens
gtgagcgcctgagagtctttttgcctttcagagttaaggcctcactggcctgggaaaataattgctgccttttgcatccgcgttggctccgtccccaggatcttcccggttcagggacctggcgatttctgagtgttccggaatcccaataaccctgtttaaagaggaatggagattgccactgtccatttagattaatgaggtgtcctgaagtgatggtgacatcaatgaaaggagggttctgacacgttctcacctcgcgggatggcagctgctgatttgtcccatggacattatctttctggggacccagtttgccttcatgaagaaaagacaccagcaggaagaatagtggctgactgcctaacagattgttatcaggattcagtgacctttgacgatgtggctgtggacttcacccaggaggagtggactttactggactcaactcagagaagcctctacagtgacgtgatgctggagaactacaagaacctggccacagtaggaggtcagatcatcaaacccagtctaatctcttggttggaacaagaagagtcaaggacagttcagggaggagttctccaaggatgggaaatgcgacttgaaacccagtggtctatacttcagcaggactttttgaggggtcagacatccattgggatacaattggaaggaaaacacaatggaagggaactctgtgactgtgagcaatgtggagaagtcttcagtgaacactcatgccttaagacgcacgtgagaactcaaagtacagggaacactcatgactgtaatcagtatggaaaagatttccttaccctgtgtgagaaaacctctactggtgagaaactttctgagtttaatcagagtgaaaaaatcttcagcctgacaccaaatattgtataccagagaactagcacacaagaaaagtcatttgaatgtagtcactgtggaaaatccttcattaatgagtcataccttcaggcacatatgagaactcacaatggagaaaaactctacgaatggaggaattatgggccaggttttattgactctacaagcctttctgtgcttatagaaaccctcaatgcaaaaaagccctacaaatgtaaggaatgtggaaaaggctatagatacccagcctacctcagtattcacatgcgaacccacactggggagaaaccatatgaatgtaaggaatgtgggaaagccttcaattattccaactcatttcagatacatggaagaactcacactggagagaaaccctatgtatgtaaggaatgtgggaaagccttcactcagtactcgggccttagtatgcatgtacgatctcacagtggagacaagccctatgaatgtaaggaatgtgggaaatccttccttacatcctcacgccttattcaacatataagaactcacactggagagaagcctttgtatgtgttgaatgtgggaaagcctttgcagtttcctcaaatcttagtggacatttgagaactcacactgaagagaaggcctgtgagtgtaagatatgtgggaaagtatttgggtatccctcatgtcttaataatcacatgcgaacgcacagtgcccagaaaccatacacctgtaaggaatgtgggaaggcttttaactattccacccaccttaaaattcacatgcgaatccacactggagaaaaaccctatgagtgtaaacaatgtggaaaggccttcagtcattccagttcatttcaaatacatgaaaggactcacactggagagaaaccctatgaatgcaaggagtgtgggaaagccttcacgtgttccagttcctttagaattcatgaaaaaactcacacagaagagaaaccctataaatgtcagcaatgcgggaaagcttacagtcatccccgttcacttcgaagacatgaacaaattcactagtgagaaactgtccatgtaataaatgtgggaaagctctcatttgttccagttcactttaaagacatgaatgaactcactctggagagaagaagctgcatgaaaattacttaattcctgtaatcccagcattttgagaggctgaggtgggtggatcacttgaggtcaggagtttgagaccaccctggccaacatggtgaaaccttgtctctactgaaaatacaaaaaatttagccaggtgtggtgggcacctgtaatcccagctacttgggaggctgaggcaagtgaatcacttgaacccaggaagcagaggttgcagtgagcagagatcatgccactgcactccagcctgggcgatggagtgagactccatctcaaaaaaa

SEQ ID NO: 280755 - DNA, 1176 bp, Homo sapiens
gtgagcgcctgagagtctttttgcctttcagagttaaggcctcactggcctgggaaaataattgctgccttttgcatccgcgttggctccgtccccaggatcttcccggttcagggacctggcgatttctgagtgttccggaatcccaataaccctgtttaaagaggaatggagattgccactgtccatttagattaatgaggtgtcctgaagtgatggtgacatcaatgaaaggagggttctgacacgttctcacctcgcgggatggcagctgctgatttgtcccatggacattatctttctggggacccagtttgccttcatgaagaaaagacaccagcaggaagaatagtggctgactgcctaacagattgttatcaggattcagtgacctttgacgatgtggctgtggacttcacccaggaggagtggactttactggactcaactcagagaagcctctacagtgacgtgatgctggagaactacaagaacctggccacagtaggaggtcagatcatcaaacccagtctaatctcttggttggaacaagaagagtcaaggacagttcagggaggagttctccaaggatgggaaatgcgacttgaaacccagtggtctatacttcagcaggactttttgaggggtcagacatccattgggatacaattggaaggaaaacacaatggaagggaactctgtgactgtgagcaatgtggagaagtcttcagtgaacactcatgccttaagacgcacgtgagaactcaaagtacagggaacactcatgactgtaatcagtatggaaaagatttccttaccctgtgtgagaaaacctctactggtgagaaactttctgagtttaatcagagtgaaaaaatcttcagcctgacaccaaatattgtataccagagaactagcacacaagaaaagtcatttgaatgtagtcactgtggaaaatccttcattaatgagtcataccttcaggcacatatgagaactcacaatggagaaaaactctacgaatggaggaattatgggccaggttttattgactctacaagcctttctgtgcttatagaaaccctcaatgcaaaaaagccctacaaatgtaaggaataaatggccaggcacggtggctcatgcctctaatcccagcactttgggaggctgaggcag

SEQ ID NO: 280756 - DNA, 791 bp, Homo sapiens
atgcaaggacagaacagaaccctgggcctgcaggcaggtggctggtgggtatcccgcctcccacccccagcaaacactggcaaaccccactctccctgcatcagggtctgagtgcctggcaggggcggcagtggagatgatcaaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggctcagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcaggtacccaggctgtgtgggggca

SEQ ID NO: 280757 - DNA, 771 bp, Homo sapiens
  misc_feature (538)..(538): n is a, c, g, or t
agcggattctattctggcatgtgccatgtgccagctgggcagctgtaggaagtcacttcctctctgagccttcacttcccagtctctaaactggggctcacaaatgtcgcattgcagtttgggggtggatcttttgtaagaatggacagaaaaaagatggtcaactgtaatgtgtggtgcatcgtgagctgtcactcccgtgtgccctggtctcctgctggcctcactgtggtttgactcagacttggactttcctggaattctgaactttgcctctctaagcaaagcccgccagggggtacactctgccttgttttccatggtgccgtgtttccagccctatccaccactggcttctgatcggctgctttttcacactgctgttcctgcaaggctgtgtggccccatggttaagggtgagggttctgcaagggtcagccagatgcgagttccggtcctaggtccaccacttactggtcaggtgacctcaaaagacatgctttgtgtctcctcctccttctgccaggattgtaagttncctgaggcctccccagccatgtggaactaactcttttcatcttctgctactgaaatttgggcctcattaaagagtaactcctcattcgccatctgtctccgtgggtttgactgctcatgtacttactgaacacctactgtgtaccaggcactgttccaggcactgggagtacagtgctgaacacaacagacaaaaatccctgccttcgcatatatcatctcgtttaatcctcg

SEQ ID NO: 280758 - DNA, 3023 bp, Homo sapiens
atgcaaggacagaacagaaccctgggcctgcaggcaggtggctggtgggtatcccgcctcccacccccagcaaacactggcaaaccccactctccctgcatcagggtctgagtgcctggcaggggcggcagtggagatgatcaaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggctcagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccaggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttac

SEQ ID NO: 280759 - DNA, 2994 bp, Homo sapiens
atgcaaggacagaacagaaccctgggcctgcaggcaggtggctggtgggtatcccgcctcccacccccagcaaacactggcaaaccccactctccctgcatcagggtctgagtgcctggcaggggcggcagtggagatgatcaaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggctcagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccaggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttac

SEQ ID NO: 280760 - DNA, 3498 bp, Homo sapiens
aggctctaggtgccccagtagcagggccttctgcagcaaggccgggaactgctgcaccattggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccaggccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtgggcgtctctttggcagcaggaggtgctcgagcttgtcggggccaccaggtgcggcccccatggtgcttaggatggtggaggccatgtcccagctccaggacgagaagacccagctacaggaggagctggtggtcctacaggagaggctggccctccgcgacagtgaccagcaggccacgtccacccagctgcagaaccaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggctcagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccaggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttac

SEQ ID NO: 280761 - DNA, 3377 bp, Homo sapiens
ggcccgagttaatcatttcctgtggaaagtgtgcgggaggggcgcgagcgggctggccgaggaggaggcggcggcgtggagctgcctcctgccggcgggccgggccgggccgagccccgggcgctgcggcgacgcctggatcctgcctccgccaggccgataccagagatgagactgaggtttctcaccggttcctaagcccagtcagagctgtcagggcgtggaaaagataccccagtctgcggtgacgaggactccagtgcccgaagtgcagctcgcccagccctagctcagtgccgagcccttagcgtggactgggctggccccggaagcccccacgggctctacctgaccctgcagcaggccctgcaggacaaggggtgcaagagccagagtcaggggacgaaagaagagaagctttggaagagacaggcgccggcccccaggcgggcccgggaggcccgggaagctggtggcaccatgaatgtagagaatacaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggctcagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccaggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttac

SEQ ID NO: 280762 - DNA, 3636 bp, Homo sapiens
aggctctaggtgccccagtagcagggccttctgcagcaaggccgggaactgctgcaccattggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccaggccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcagagacagggtttcaccatgctggccatgctgctctcgaagtcctaacctcaggtgatccaaccgcctcagcctctcaaagtgctgggattacaggtgtgagccactgcgcccagcaggaatattcctaaatataagagggtgggcgtctctttggcagcaggaggtgctcgagcttgtcggggccaccaggtgcggcccccatggtgcttaggatggtggaggccatgtcccagctccaggacgagaagacccagctacaggaggagctggtggtcctacaggagaggctggccctccgcgacagtgaccagcaggccacgtccacccagctgcagaaccaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggctcagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccaggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttac

SEQ ID NO: 280763 - DNA, 2609 bp, Homo sapiens
ctctagaggacccccgcacgttcgggaggtgcagcagaagaccgaccggctggctgaggtggagctgcgactcaaggactgcctggctgagaaggcacaggaggaggagcggctcagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccaggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttac

SEQ ID NO: 280764 - DNA, 1828 bp, Homo sapiens
agcggattgtgagctgagtgactgcagtaacacgtgatgtggtgttgctgaaggacagcatggttggggaggtggctggacttgtagctggtggtcccagcggccctggaagcccccccaccagcctccctcccaccaccctcccaggtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccaggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttac

SEQ ID NO: 280765 - DNA, 1124 bp, Homo sapiens
  misc_feature (922)..(922): n is a, c, g, or t
  misc_feature (929)..(929): n is a, c, g, or t
atgcaaggacagaacagaaccctgggcctgcaggcaggtggctggtgggtatcccgcctcccacccccagcaaacactggcaaaccccactctccctgcatcagggtctgagtgcctggcaggggcggcagtggagatgatcaaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggctcagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcagggtcnggacaanctgctgcccttgcagccgggaacgcagagcctcaacaaggatacaatgggcacaagggagatggacaggatccaatgagctagcaagaagacctagaaagtacagggcgcgatagcgaagacatgagaggaaaaggagcacagagataagagcaagtcaacacgaggacagaagagagccagagcgcgcgagacg

SEQ ID NO: 280766 - DNA, 1092 bp, Homo sapiens
aggctctaggtgccccagtagcagggccttctgcagcaaggccgggaactgctgcaccattggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccaggccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcagagacagggtttcaccatgctggccatgctgctctcgaagtcctaacctcaggtgatccaaccgcctcagcctctcaaagtgctgggattacaggtgtgagccactgcgcccagcaggaatattcctaaatataagaggtgtgtctgccacccgcccttctcaagtggagctctgggtcgagagagggagggggtgaattttgggctaaggagcctgctgatgtcacttttcttgtcttttcaattatctgtattggctttttgattgtcaaagtaaaaaaatgtgaagattacaggaatcatgtcctgataatagctacctcatatcaagccctcactatgtgccaggcaccttctggggacttggctgcagttgtctgttactcttcacacaagctcaatgaggcggtcctgttattaccatttttattttaagaatgaggagaatgcagcttcaagaaggtaagcaacttgccgaccgtcacacagcttagccgaggaagagccaggcttcacacacgggccttgccgcctctagactacgtgtttattttttagactgagcacttttaaaagagtggcttattttttttgttttgaatttaaaggtcacaaagacacacagaaattgtttgctatctctcttccaagataacctctgttgatatgaaaaaaa

SEQ ID NO: 280767 - DNA, 986 bp, Homo sapiens
agcggattctattctggcatgtgccatgtgccagctgggcagctgtaggaagtcacttcctctctgagccttcacttcccagtctctaaactggggctcacaaatgtcgcattgcagtttgggggtggatcttttgtaagaatggacagaaaaaagatggtcaactgtaatgtgtggtgcatcgtgagctgtcactcccgtgtgccctggtctcctgctggcctcactgtggtttgactcagacttggactttcctggaattctgaactttgcctctctaagcaaagcccgccagggggtacactctgccttgttttccatggtgccgtgtttccagccctatccaccactggcttctgatcggctgctttttcacactgctgttcctgcaaggctgtgtggccccatggttaagggtgagggttctgcaagggtcagccagatgcgagttccggtcctaggtccaccacttactggtcaggtgacctcaagtaagttgcctaaccaaggcttaacctcttaggagctcagtttttcttcctgtaaaatggggataataatagtacctacctcaggggaataggggatgaggggctccattatcactgttgggacctgggcttgtgggagctcaggagtcttctcagacctcctcattgctgtgccaggtggaggaggtgtttgtatttactgagagcaattgggccaatggcccatagtccttgagcacccagctgacccaggccacagaggctgctcatcttggtctggtgaccacaggaggctgtggctgttgggatgaccctccccagtgttgttaacaacagtcccaggccatgtcctgctggccttgagttcccctgtcctcttgtgaatgtccctagagccatggcctcaaggttcctgaagttcccaataatgtgacatgctgcccagacctcactacattccagcctgggcaacagagcaagaccctgtctcaaaaa

SEQ ID NO: 280768 - DNA, 287 bp, Homo sapiens
ggcagagctccaccccagtcaactggtctgttcaagaagaaatgtactaagtgaattcatactatagtgtgaatgacggataacagctttgtgggcccccttcccctagggggctgtgcttaaaagtcaggggactcctaggtcaactagtctgcctgggacaccagtggaccagaatggagactggtcttgacatggcctggacccatttccccatccccaaccaatccagggaacatccgagtgattgctcgtgtccggccagtcaccaaagaggatggggaagg

SEQ ID NO: 280769 - DNA, 494 bp, Homo sapiens
tccctgcatcagggtctgagtgcctggcaggggcggcagtggagatgatcaaggttagtgcgcccagccccatgctgaggcagcagcctttctggggagggagggggcgtggaaggagacttcaaccttttgaagaggaagtcagttcacttatgtcagggtagggagagtaggaattacgtattctttgagactgaaaaattactggccgggcgcaggggctcacaacggtaatcccagcactttgggaggctgaggcgggaagactgcttgaggccaggaattcaaggccagcttgggcaaaatggcaagacccttctatacattaaaaaaaaaaaaaaaattagccgggcgtgatggtatgtgcttgtagtcccagctactcgggaggctgagatgggaggatggcttgagtccaggaggtctaggctgcagtgagcctagatcgaggcactgcactccagcctgggtgacagagtgagaccctgtctcaa

SEQ ID NO: 280770 - DNA, 755 bp, Homo sapiens
ggcccgagttaatcatttcctgtggaaagtgtgcgggaggggcgcgagcgggctggccgaggaggaggcggcggcgtggagctgcctcctgccggcgggccgggccgggccgagccccgggcgctgcggcgacgcctggatcctgcctccgccaggccggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccaggccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcagagacagggtttcaccatgctggccatgctgctctcgaagtcctaacctcaggtgatccaaccgcctcagcctctcaaagtgctgggattacaggtgtgagccactgcgcccagcaggaatattcctaaatataagagggtagaacacctgaaggagaagctcattagccaggcccaggaagtgagccgactgcgatctgagctggtgaggccacaaggctgtcctggggtagcgcagggcc

SEQ ID NO: 280771 - DNA, 3392 bp, Homo sapiens
ggcccgagttaatcatttcctgtggaaagtgtgcgggaggggcgcgagcgggctggccgaggaggaggcggcggcgtggagctgcctcctgccggcgggccgggccgggccgagccccgggcgctgcggcgacgcctggatcctgcctccgccaggccggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccaggccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggctcagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccaggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttac

SEQ ID NO: 280772 - DNA, 3459 bp, Homo sapiens
agcggattctattctggcatgtgccatgtgccagctgggcagctgtaggaagtcacttcctctctgagccttcacttcccagtctctaaactggggctcacaaatgtcgcattgcagtttgggggtggatcttttgtaagaatggacagaaaaaagatggtcaactgtaatgtgtggtgcatcgtgagctgtcactcccgtgtgccctggtctcctgctggcctcactgtggtttgactcagacttggactttcctggaattctgaactttgcctctctaagcaaagcccgccagggggtacactctgccttgttttccatggtgccgtgtttccagccctatccaccactggcttctgatcggctgctttttcacactgctgttcctgcaaggctgtgtggccccatggttaagggtgagggttctgcaagggtcagccagatgcgagttccggtcctaggtccaccacttactggtcaggtgacctcaaaactcttttcatcttctgctactgaaatttgggcctcattaaagagtaactcctcattcgccatctgtctccgtgggtttgactgctcatgtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggctcagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccaggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttac

SEQ ID NO: 280773 - DNA, 3534 bp, Homo sapiens
  misc_feature (538)..(538): n is a, c, g, or t
agcggattctattctggcatgtgccatgtgccagctgggcagctgtaggaagtcacttcctctctgagccttcacttcccagtctctaaactggggctcacaaatgtcgcattgcagtttgggggtggatcttttgtaagaatggacagaaaaaagatggtcaactgtaatgtgtggtgcatcgtgagctgtcactcccgtgtgccctggtctcctgctggcctcactgtggtttgactcagacttggactttcctggaattctgaactttgcctctctaagcaaagcccgccagggggtacactctgccttgttttccatggtgccgtgtttccagccctatccaccactggcttctgatcggctgctttttcacactgctgttcctgcaaggctgtgtggccccatggttaagggtgagggttctgcaagggtcagccagatgcgagttccggtcctaggtccaccacttactggtcaggtgacctcaaaagacatgctttgtgtctcctcctccttctgccaggattgtaagttncctgaggcctccccagccatgtggaactaactcttttcatcttctgctactgaaatttgggcctcattaaagagtaactcctcattcgccatctgtctccgtgggtttgactgctcatgtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggctcagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccaggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttac

SEQ ID NO: 280774 - DNA, 3411 bp, Homo sapiens
cagtgtgagtgcatgtgcgccagcgcgtgcaaggacacggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccaggccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcagcaggccctgcaggacaaggggtgcaagagccagagtcaggggacgaaagaagagaagctttggaagagacaggcgccggcccccaggcgggcccgggaggcccgggaagctggtggcaccatgaatgtagagaatacaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggctcagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccaggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttac

SEQ ID NO: 280775 - DNA, 1114 bp, Homo sapiens
gtgctgaggtaatctagaggatcccgatggcgggcgtccgtcattgctgccctgcgctcccgccaggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttac

SEQ ID NO: 280776 - DNA, 1493 bp, Homo sapiens
  misc_feature (1291)..(1291): n is a, c, g, or t
  misc_feature (1298)..(1298): n is a, c, g, or t
ggcccgagttaatcatttcctgtggaaagtgtgcgggaggggcgcgagcgggctggccgaggaggaggcggcggcgtggagctgcctcctgccggcgggccgggccgggccgagccccgggcgctgcggcgacgcctggatcctgcctccgccaggccggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccaggccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggctcagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcagggtcnggacaanctgctgcccttgcagccgggaacgcagagcctcaacaaggatacaatgggcacaagggagatggacaggatccaatgagctagcaagaagacctagaaagtacagggcgcgatagcgaagacatgagaggaaaaggagcacagagataagagcaagtcaacacgaggacagaagagagccagagcgcgcgagacg

SEQ ID NO: 280777 - DNA, 694 bp, Homo sapiens
cagtgtgagtgcatgtgcgccagcgcgtgcaaggacacggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccaggccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcagcaggccctgcaggacaaggggtgcaagagccagagtcaggggacgaaagaagagaagctttggaagagacaggcgccggcccccaggcgggcccgggaggcccgggaagctggtggcaccatgaatgtagagaatacaggtaaagcaggcctgcccgccaaaccggcactccccagtgaagccagcgcaggagggaggctcttgtgcagttggtatatccccatgccctgtcctgcccggctggaggtggcctagacagactccagctgcctgatccgcagctgcatcccccagcctgcc

SEQ ID NO: 280778 - DNA, 1324 bp, Homo sapiens
aaagaaaaaaaaaaggaggaggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaaggttaggagaaaaagagattgcatattttccactatttgttgtatgtttattctattttatagattctattatccttaaaacaccttatttggaaataaaaggtgattcccttggt

SEQ ID NO: 280779 - DNA, 3263 bp, Homo sapiens
aaagaaaaaaaaaaggaggaggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtag

SEQ ID NO: 280780 - DNA, 3385 bp, Homo sapiens
aaagaaaaaaaaaaggaggaggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggaaggagtctccctctgtcgcacaggctaaagtgcaatggcgcgatctcggctcactgcaactctcgcctcccaggttcaagcgattctcctgcctcagtctcctgagtagctgggattacagggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtag

SEQ ID NO: 280781 - DNA, 2217 bp, Homo sapiens
aaagaaaaaaaaaaggaggaggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaaggttaggagaaaaagagattgcatattttccactatttgttgtatgtttattctattttatagattctattatccttaaaacaccttatttggaaataaaaggtgattcccttggtatgccttcctagccaacaggttattatttttttaaaaattctaagatgtaatatacttctttgaccatactgattaataaagcctatgggaatgaaactaagtggtaagtaaagctcttacatgatgcaaaatgctacttttttttttgtcctggttttcttgtgccatattaaatatcttttaaggaagaatagcttcagtgtttcagaattaaaattactagctccattcatattttattttcaaatgtattttttaatactttagtctcttagtagggtaggaatttagtctacataaaatttatacaggagagagtttctccctttattttgtactcacaactactccataaatgactttgtcagtttaccagctctacagctttggttttagaattgaacgcctgactgaggtacagttctttttgtttagaatcctgagttcaacttatcatgtagggtggcttcttatttccaaggtgtttaaacggttccacacaaatttttgtagatttctcccaaggaaaatgactggtaaggtaactgaatcttgttttagaattatttctctcataaattggtcatgttatcccttatttttctagaatgaaaagaggagtctgttatgtaactgcttatattccattgtatttacatttttattttaattaaaaaaaaacatttgtttgatcttttaccttctttgagggaaaggcaatcttaaaagttccccagtataggctggtttctccaaattcaattatagaattagggtttctccctggaatacatttctctcaaaaatactgatatgctcattgtaaaccgttggttacatttccctgtcagccctttttatagaagattgtgtgggtgaatgttgtatgctt

SEQ ID NO: 280782 - DNA, 1175 bp, Homo sapiens
aaagaaaaaaaaaaggaggaggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaggaataccaagcaggcatttttaattgatttggggggagtttgccggaagaagaaaatgat

SEQ ID NO: 280783 - DNA, 333 bp, Homo sapiens
taactaattggcaatgaacagctgtgtgagaaaggcctgtgagttgcttctaaatgctttattactaatatcaactctgtttctacagaccagaacttctgactcacagtaccactgaagttactcagccaagaacgaatacaccaggtaaactagttgtgaaatccttttttaaaaacacagatcagccaggctcggtggctcacacctgtaatcccagcactttaggaggctgaggcgggcagatcacaaggtcaggagatcaagaccatcctggctaacatggtgaaaccccatgtctactaaaatacaaaaaaattagccgggcctggt

SEQ ID NO: 280784 - DNA, 453 bp, Homo sapiens
ctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagaggtgaagtgctttctccctttgtacccatcaacagttgattcgtataaatttgaatatttagcttacgttaatgtatttttaaaatttatatttaacacagaagtcatttaaatgtatgctttacaataattttgcgtattcatacgaagttttgttttgttttgttttaatgcagaccttttttagagccaaagaagcatgtaggtaagtaagtgctttgcttccttgatagctggctggcctccgttttgctagattttcatacactttaatgg

SEQ ID NO: 280785 - DNA, 501 bp, Homo sapiens
ctcccggattcaagtgattcaggtgagcgccaccacgcctggctaatttttgtatttttagtagagatgaggtttcaccatattggccaggctggtcttgaactcctgacctcgtgatctgcccgcctcggcctcccaatgtgttgggattacaggcgtgagccactgtgcccggcccaataactcttatttatgcaataaataaatatgtcagttttaagctgagtcaggtttgcacccaccttggtcaagggagggatcttaacactttgagacccagagactttgaatgctgtgggaatggctgtcaccagcacgtggcttgatcagggctttcttctccttgcagttgtggccccatcaaagtgaaaactgaacccacagaagattctggtatgtactagcacttttagaatcaatggtgaaattaaggaagacttttccttagtgtagaagtttatagtttgactcaattattgttttgttttgataagaaagagg

SEQ ID NO: 280786 - DNA, 390 bp, Homo sapiens
tattattatttttttattttattttttattttttttacaggtgttgaagaagaagaaaaagctgcagagatgcataaaatgaaatctacaacccaggcaaatcggatgagtgtagatgctgtagaaattgaaacactcagaaaaacagttgaggactatttctgcttttgctatggtaaaaacaatagatttaatttttctaaaagatacattatataattgaattttctaaagggaagcttatgtaattgattcgaaaatcatataacacacattttcagtgactgaatggattagcaataaccttactttcttccacttccattttgaaggaacccaggaggaagtgtggccagtagagctgtttctttctttctgtttttttttttt

SEQ ID NO: 280787 - DNA, 3121 bp, Homo sapiens
ctgtctcccaagctggagtgcagtggtgtggtcataggtcactgcagcgtcgaactcctaggctcaagtgatcctcttgcctcaggctcctgagtagctgggacaacaggcgtgtaccacacctggatactttttaaatttttggtagagaagggatctcactctattgccaagctggtgtcgaactcttggtcttaagcagccctcccacgtcagcatcccaaagtgttgggatttcagagggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtag

SEQ ID NO: 280788 - DNA, 3326 bp, Homo sapiens
aaagaaaaaaaaaaggaggaggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtag

SEQ ID NO: 280789 - DNA, 1240 bp, Homo sapiens
aaagaaaaaaaaaaggaggaggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggtataatcttttcacttccattctccca

SEQ ID NO: 280790 - DNA, 840 bp, Homo sapiens
agcagttgttgtccaaccaggaaagacttcactggtgagaaaatatttcaagaagataccatcccacgaatacaggcttgttttccttctttctatctgtgttcgtgggatggtatcttcttgaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatcca

SEQ ID NO: 280791 - DNA, 2617 bp, Homo sapiens
atgtccgaaagggaaagccagaaaagcagcaaaagcaatggtggcactggagcccctaaggcgccagcgcaaccagagcgcgagcgattggtcggggcgtgtgggggcggtgcgtcttcctcgagaatggatttgattggtggagcgtggaaatggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatccaaaaaaaatacggcttttccaatgatgaaatataatcagaagatgaaaaatagttctaaactatcaataatacaaagcaaatttctatcagccttgctaaagctaggggcccactaaatatttttatcggctaggcgtggtggtgcatgcctgtaatctcggaaggctgaggcaggaggatcatttgagctcatgagggcccaggaggtcaaggcttcagtgagccatgatcatgccactgcactccagtctggatgacagagagagaccctgtctcaaaaaatatatatttaaaaaataaaaataaaagctgaccccaaagacaaataagatt

SEQ ID NO: 280792 - DNA, 3541 bp, Homo sapiens
atgtccgaaagggaaagccagaaaagcagcaaaagcaatggtggcactggagcccctaaggcgccagcgcaaccagagcgcgagcgattggtcggggcgtgtgggggcggtgcgtcttcctcgagaatggatttgattggtggagcgtggaaatggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgaggctcactcccatccataattcagcacatttggtctctgaggcaaaataagtccaccattatggttaagactatttattggatacaaatgctattacagtcacaaacaattgtgttcctggctgcggggaagcgggtggcatgtgggttttggggtttttgatcagtaggcgctcccaagtccacaaagaccagtccagcggcgtggcctctgactcatctccagtggtttgtcacctctggccctgttcctgtcattccctatttgtgtgctatctctaagcctgacgtggttttcctcctgtcaaaagtacaccactacaggaaagcaggaaggtttgggcctgcaatgtatgcatattgggtttctcttagtggtctcagactacgtttgtggtgactgggtcctgcttcagccctgttgaatatgcccagcctgtggcatgctggtggtcatcctggcagctggtgggtggcctggtatgctgcccactcagcttgagactcaccctcatgcattcagccagtaggtctggccaagcctgaactgaaggaccatggtcctatcccagcttcatcagagcaatccattgtgacctgagaatccatttaacctctcggtctagaacctccttctggaaagtgaggtattaatacttgactcatgttatcgccaccccacattctaagtcatggttgagtagtaatttggacagtaccttgtaaattgtgtgagattaccttaatataaggtataacttaaaatattcatgaatcccaggaggttaaaggttataacttttaggtatggtatcgtaatgtactgtcccccagcaaacatttaaaaagccaattttaaaaaatgtatttctgactaagttacattaaggtctctgcctctgtatcttatgtttcttccaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatccaaaaaaaatacggcttttccaatgatgaaatataatcagaagatgaaaaatagttctaaactatcaataatacaaagcaaatttctatcagccttgctaaagctaggggcccactaaatatttttatcggctaggcgtggtggtgcatgcctgtaatctcggaaggctgaggcaggaggatcatttgagctcatgagggcccaggaggtcaaggcttcagtgagccatgatcatgccactgcactccagtctggatgacagagagagaccctgtctcaaaaaatatatatttaaaaaataaaaataaaagctgaccccaaagacaaataagatt

SEQ ID NO: 280793 - DNA, 3226 bp, Homo sapiens
atgtccgaaagggaaagccagaaaagcagcaaaagcaatggtggcactggagcccctaaggcgccagcgcaaccagagcgcgagcgattggtcggggcgtgtgggggcggtgcgtcttcctcgagaatggatttgattggtggagcgtggaaatggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggtgagaaaatatttcaaggaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgaggctcactcccatccataattcagcacatttggtctctgaggcaaaataagtccaccattatggttaagactatttattggatacaaatgctattacagtcacaaacaattgtgttcctggctgcggggaagcgggtggcatgtgggttttggggtttttgatcagtaggcgctcccaagtccacaaagaccagtccagcggcgtggcctctgactcatctccagtggtttgtcacctctggccctgttcctgtcattccctatttgtgtgctatctctaagcctgacgtggttttcctcctgtcaaaagtacaccactacaggaaagcaggaaggtttgggcctgcaatgtatgcatattgggtttctcttagtggtctcagactacgtttgtggtgactgggtcctgcttcagccctgttgaatatgcccagcctgtggcatgctggtggtcatcctggcagctggtgggtggcctggtatgctgcccactcagcttgagactcaccctcatgcattcagccagtaggtctggccaagcctgaactgaaggaccatggtcctatcccagcttcatcagagcaatccattgtgacctgagaatccatttaacctctcggtctagaacctccttctggaaagtgaggtattaatacttgactcatgttatcgccaccccacattctaagtcatggttgagtagtaatttggacagtaccttgtaaattgtgtgagattaccttaatataaggtataacttaaaatattcatgaatcccaggaggttaaaggttataacttttaggtatggtatcgtaatgtactgtcccccagcaaacatttaaaaagccaattttaaaaaatgtatttctgactaagttacattaaggtctctgcctctgtatcttatgtttcttccaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatcca

SEQ ID NO: 280794 - DNA, 2231 bp, Homo sapiens
atgtccgaaagggaaagccagaaaagcagcaaaagcaatggtggcactggagcccctaaggcgccagcgcaaccagagcgcgagcgattggtcggggcgtgtgggggcggtgcgtcttcctcgagaatggatttgattggtggagcgtggaaatggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatcca

SEQ ID NO: 280795 - DNA, 2595 bp, Homo sapiens
atgtccgaaagggaaagccagaaaagcagcaaaagcaatggtggcactggagcccctaaggcgccagcgcaaccagagcgcgagcgattggtcggggcgtgtgggggcggtgcgtcttcctcgagaatggatttgattggtggagcgtggaaatggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagaagcctagtgtgtgtgctttcttaatgtgtgtgccaatggtggatctttgctactgaatgtgtttgaacatgttttgagatttttttaaaataaattattatttgacaacaatccaaaaaaaatacggcttttccaatgatgaaatataatcagaagatgaaaaatagttctaaactatcaataatacaaagcaaatttctatcagccttgctaaagctaggggcccactaaatatttttatcggctaggcgtggtggtgcatgcctgtaatctcggaaggctgaggcaggaggatcatttgagctcatgagggcccaggaggtcaaggcttcagtgagccatgatcatgccactgcactccagtctggatgacagagagagaccctgtctcaaaaaatatatatttaaaaaataaaaataaaagctgaccccaaagacaaataagatt

SEQ ID NO: 280796 - DNA, 1817 bp, Homo sapiens
agcagttgttgtccaaccaggaaagacttcactggtgagaaaatatttcaagaagataccatcccacgaatacaggcttgttttccttctttctatctgtgttcgtgggatggtatcttcttgaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgaggctcactcccatccataattcagcacatttggtctctgaggcaaaataagtccaccattatggttaagactatttattggatacaaatgctattacagtcacaaacaattgtgttcctggctgcggggaagcgggtggcatgtgggttttggggtttttgatcagtaggcgctcccaagtccacaaagaccagtccagcggcgtggcctctgactcatctccagtggtttgtcacctctggccctgttcctgtcattccctatttgtgtgctatctctaagcctgacgtggttttcctcctgtcaaaagtacaccactacaggaaagcaggaaggtttgggcctgcaatgtatgcatattgggtttctcttagtggtctcagactacgtttgtggtgactgggtcctgcttcagccctgttgaatatgcccagcctgtggcatgctggtggtcatcctggcagctggtgggtggcctggtatgctgcccactcagcttgagactcaccctcatgcattcagccagtaggtctggccaagcctgaactgaaggaccatggtcctatcccagcttcatcagagcaatccattgtgacctgagaatccatttaacctctcggtctagaacctccttctggaaagtgaggtattaatacttgactcatgttatcgccaccccacattctaagtcatggttgagtagtaatttggacagtaccttgtaaattgtgtgagattaccttaatataaggtataacttaaaatattcatgaatcccaggaggttaaaggttataacttttaggtatggtatcgtaatgtactgtcccccagcaaacatttaaaaagccaattttaaaaaatgtatttctgactaagttacattaaggtctctgcctctgtatcttatgtttcttccaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatcca

SEQ ID NO: 280797 - DNA, 396 bp, Homo sapiens
atctgatcatttaaaagctaatcatgcaaggccagttttcagcataatttggactattagcccaatatattagcagttttggcatttgattctgaaagtggttgctggttcagataatggcttctcaccagtgtttttttgttttttgttttctttaaaaaaaaaaaccctctggatgagatttctatgagaaactacttgaacatgaaatcagcccacctggagtcttgtaatcattcagttacttttacttcccaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattg

SEQ ID NO: 280798 - DNA, 2284 bp, Homo sapiens
atgtccgaaagggaaagccagaaaagcagcaaaagcaatggtggcactggagcccctaaggcgccagcgcaaccagagcgcgagcgattggtcggggcgtgtgggggcggtgcgtcttcctcgagaatggatttgattggtggagcgtggaaatggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatcca

SEQ ID NO: 280799 - DNA, 3208 bp, Homo sapiens
atgtccgaaagggaaagccagaaaagcagcaaaagcaatggtggcactggagcccctaaggcgccagcgcaaccagagcgcgagcgattggtcggggcgtgtgggggcggtgcgtcttcctcgagaatggatttgattggtggagcgtggaaatggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgaggctcactcccatccataattcagcacatttggtctctgaggcaaaataagtccaccattatggttaagactatttattggatacaaatgctattacagtcacaaacaattgtgttcctggctgcggggaagcgggtggcatgtgggttttggggtttttgatcagtaggcgctcccaagtccacaaagaccagtccagcggcgtggcctctgactcatctccagtggtttgtcacctctggccctgttcctgtcattccctatttgtgtgctatctctaagcctgacgtggttttcctcctgtcaaaagtacaccactacaggaaagcaggaaggtttgggcctgcaatgtatgcatattgggtttctcttagtggtctcagactacgtttgtggtgactgggtcctgcttcagccctgttgaatatgcccagcctgtggcatgctggtggtcatcctggcagctggtgggtggcctggtatgctgcccactcagcttgagactcaccctcatgcattcagccagtaggtctggccaagcctgaactgaaggaccatggtcctatcccagcttcatcagagcaatccattgtgacctgagaatccatttaacctctcggtctagaacctccttctggaaagtgaggtattaatacttgactcatgttatcgccaccccacattctaagtcatggttgagtagtaatttggacagtaccttgtaaattgtgtgagattaccttaatataaggtataacttaaaatattcatgaatcccaggaggttaaaggttataacttttaggtatggtatcgtaatgtactgtcccccagcaaacatttaaaaagccaattttaaaaaatgtatttctgactaagttacattaaggtctctgcctctgtatcttatgtttcttccaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatcca

SEQ ID NO: 280800 - DNA, 2302 bp, Homo sapiens
atgtccgaaagggaaagccagaaaagcagcaaaagcaatggtggcactggagcccctaaggcgccagcgcaaccagagcgcgagcgattggtcggggcgtgtgggggcggtgcgtcttcctcgagaatggatttgattggtggagcgtggaaatggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggtgagaaaatatttcaaggaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatcca

SEQ ID NO: 280801 - DNA, 2564 bp, Homo sapiens
atgtccgaaagggaaagccagaaaagcagcaaaagcaatggtggcactggagcccctaaggcgccagcgcaaccagagcgcgagcgattggtcggggcgtgtgggggcggtgcgtcttcctcgagaatggatttgattggtggagcgtggaaatggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatccaaaaaaaatacggcttttccaatgatgaaatataatcagaagatgaaaaatagttctaaactatcaataatacaaagcaaatttctatcagccttgctaaagctaggggcccactaaatatttttatcggctaggcgtggtggtgcatgcctgtaatctcggaaggctgaggcaggaggatcatttgagctcatgagggcccaggaggtcaaggcttcagtgagccatgatcatgccactgcactccagtctggatgacagagagagaccctgtctcaaaaaatatatatttaaaaaataaaaataaaagctgaccccaaagacaaataagatt

SEQ ID NO: 280802 - DNA, 1859 bp, Homo sapiens
agctaggtcgaggccgggtgtgaatcggccgaggggaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatcca

SEQ ID NO: 280803 - DNA, 1670 bp, Homo sapiens
ccaattttccattgaaatatgttgacaaatttccttacacataaatgtctattcatatcagatgatttcaacaatgataaattcttagaaacataatttctgggtctgaactttttttttttttttttttttgagacagagtcccctctctactaaaaatacaaaaattagctgggcgtggtggtgcacacctgtaatcccggctactcaggaggctgatgcagaagaatcgcttgaacccaggaggagacggaggttgcagtgagccaagatcacgccattgcactccagcctgggtgacagagtgaggctttgtctcaaaaataaaataataaaataaatgaaataagataaaataaaaatacagtactttgataaggaaaggtaactgtcagaaaggtgcgattcccccagtcctcacttaggagagagaccaacagcctgagttaaccaagtcctttgtagcccacagcaacagggagctagggactgagtcaggctctctgtaactgtccctatttgccctgggtccccaggagggtaatgttattaagcttcaggtatctgtcgctgttcttcttgaggccacaaggaggcagcacagtgtctctgtcaggaaaatacacttggatgtggtgacagacgttttcccgaggcttacgtttgattctgcaccaggcgctgcgtacacctgcttggaggctgcaacggggcgggctctgctgcgtcaacacatggacatcactggagaggaaaacccactcaacaagctccgcgtgaagattgaaccaggtccaggaggctcctctgtctgacacccactcccctcaattgagcttggagccccaagttaatgcgaacttcatgttgatcagtgcacgcttagaatactttatttggagggaggggcactccagagctctttgtagccaattctctggcccctgggctgactgaacccaagccattgcagccagataggagttctgtccagtctgtgcggttcgtgatgacttcaccattgctttgcatttgcacaagtccatatcgttttaccaggctctttcgcattccttcatgatcatcagggcagatctgtggattctgtagaataaaagcattagccttattttacagaggatgggactgagtgccagacaagttaagtgtcttgtccaggtcatgtacctaatcagtgcatgactgcaactgagatccgggtcctctctccaaattcagatctttttacttcctaacattttccttcattccatgtgtgactaatctgaaacctttttatgcaattgaagctcatgttccttgatgccgttaagtttgcagatgaatttcttagagacgggtaattagttttagcctggaacagctgtaaaaacaacacattggctgggcatggtggttcacgcctgtaatcccaggtcaaagcgggtggatcatgaggtcaagagttcgagaccagcctagccaatatggagaaccctgtctctactaaaaatacaaaaattagctgggtgtggtgatgcacacctgtaatcccagctactggggaggctgaggcaggagaatcgctcgaccccaggaggcagaggttgcagtgagctgagatcgtgccactgcactccagcctgggtgatagagcaagactccgtctt

SEQ ID NO: 280804 - DNA, 2409 bp, Homo sapiens
gccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280805 - DNA, 3851 bp, Homo sapiens
  misc_feature (1116)..(1116): n is a, c, g, or t
  misc_feature (1131)..(1131): n is a, c, g, or t
  misc_feature (1256)..(1256): n is a, c, g, or t
  misc_feature (1731)..(1731): n is a, c, g, or t
  misc_feature (1921)..(1921): n is a, c, g, or t
  misc_feature (2040)..(2040): n is a, c, g, or t
  misc_feature (2062)..(2062): n is a, c, g, or t
ttcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggagtaaaagtccctcgcaatttcgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctcccnttaccctcccgcctnccaccctccctgcaacaacagccctctagcctggggggcttgttagagtagatgtgaaggtttcaggtcgcagcctgtgggactactgctaggtgtgtggggtgtttcgcctgcacccctggttnctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctccccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtcnttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagnaccttgaatccggtgcatgccttggttttggtgctgctgctgcttcccaagatcctcagcagggattaagaaggaacccggtgtgcacagcagatccccgaaattggtgggcttgaccncctggcaaattgctgcgtcttnccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaaaaaaaaaacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280806 - DNA, 3550 bp, Homo sapiens
  misc_feature (815)..(815): n is a, c, g, or t
  misc_feature (830)..(830): n is a, c, g, or t
  misc_feature (955)..(955): n is a, c, g, or t
  misc_feature (1430)..(1430): n is a, c, g, or t
  misc_feature (1620)..(1620): n is a, c, g, or t
  misc_feature (1739)..(1739): n is a, c, g, or t
  misc_feature (1761)..(1761): n is a, c, g, or t
aggaaagcattttatctccacagcaatcctatgaggttgatactactatcctcatagaaggggaaactgatgccaggagaggttcaagcgtcttacctgaagtcacaaagcaaactgagtgatgaaggaagacttgaacctagaaaatttcactgcaaagacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctcccnttaccctcccgcctnccaccctccctgcaacaacagccctctagcctggggggcttgttagagtagatgtgaaggtttcaggtcgcagcctgtgggactactgctaggtgtgtggggtgtttcgcctgcacccctggttnctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctccccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtcnttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagnaccttgaatccggtgcatgccttggttttggtgctgctgctgcttcccaagatcctcagcagggattaagaaggaacccggtgtgcacagcagatccccgaaattggtgggcttgaccncctggcaaattgctgcgtcttnccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaaaaaaaaaacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280807 - DNA, 690 bp, Homo sapiens
ctgtgtggtgatccgatcttgcactccgtcactgtggctgactgcattgtcacattcacttggcggaggccaatttcctacaggtgctttcaggatcaggtcactgcgatggtctctaaacaccattctgctttctctgctctcttgtctttaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccgcacgacacctataactgagaccatgtatcgagaagtacgcgagcatcgattcgtatca

SEQ ID NO: 280808 - DNA, 516 bp, Homo sapiens
ctgtgtggtgatccgatcttgcactccgtcactgtggctgactgcattgtcacattcacttggcggaggccaatttcctacaggtgctttcaggatcaggtcactgcgatggtctctaaacaccattctgctttctctgctctcttgtctttaggagccgggtgtgggctgagccctgcctgattgatgctgccaaggaggagtacaacggggtgatagaagaatttttggcaacaggagagaagctttttggaccttatgtttggggaaggtgtggtatcacattgactctagtgtctcctgttaaactgagtcactggcttccattcttcctcttcgtgtggcttttccacctcctgcctcccagagcaaagtttccctgatcccagaagtgaaggagaggaggaagagaggagggtatgagccaggcttctcactgttgctgaggagagggcctaggagatgaggttctttgtgtgtgtgtgtgtgtgtgtgtgtgtgtgtgtgtgtgtgtgt

SEQ ID NO: 280809 - DNA, 630 bp, Homo sapiens
tacagatgacaagatcagaggctcggtccaaggtctctgagatgacccatgggatgcagtgaggaatggaccctttctggtggctctgccctgtgaagtggatgtcatactttggcatggattccaggatgaactaaatacacagaggagagagctttctagttcaaaccagactggctggcggaaaggttttaaggattacctaaaattctctcattccagccagctcacttctctggccagactgagctcgtgtgggagatgtcagttctgaaatgttcttcttttcgcttaggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtaaggagactaaggttaggtgcacctgcccttgggatgaagaaatgatttcagatctatcaatcaggtcacgtttcagtggtaaattattatatccattcagtggtacttctgaaaaattgcttacttttaaattcttccacctactgaagttgtatgtagcctctgtatacggtgccgagctcgattcgtat

SEQ ID NO: 280810 - DNA, 2122 bp, Homo sapiens
  misc_feature (27)..(28): n is a, c, g, or t
  misc_feature (30)..(32): n is a, c, g, or t
  misc_feature (39)..(42): n is a, c, g, or t
  misc_feature (44)..(44): n is a, c, g, or t
atcacgccactgggcggtgcatccttnncnnnttcggcnnnngngtctcctccctggccctggaggcttgtccagatgcgccgcattcccgctcatcgcacactgccgtttctaacattttccgtggctttctagatgacctgttgttcatgcacttcacttagtgccctcttggacttttgggccgaggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280811 - DNA, 2228 bp, Homo sapiens
tacagatgacaagatcagaggctcggtccaaggtctctgagatgacccatgggatgcagtgaggaatggaccctttctggtggctctgccctgtgaagtggatgtcatactttggcatggattccaggatgaactaaatacacagaggagagagctttctagttcaaaccagactggctggcggaaaggttttaaggattacctaaaattctctcattccagccagctcacttctctggccagactgagctcgtgtgggagatgtcagttctgaaatgttcttcttttcgcttaggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280812 - DNA, 1797 bp, Homo sapiens
ctgtgtggtgatccgatcttgcactccgtcactgtggctgactgcattgtcacattcacttggcggaggccaatttcctacaggtgctttcaggatcaggtcactgcgatggtctctaaacaccattctgctttctctgctctcttgtctttaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280813 - DNA, 2173 bp, Homo sapiens
gccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280814 - DNA, 2119 bp, Homo sapiens
  misc_feature (27)..(28): n is a, c, g, or t
  misc_feature (30)..(32): n is a, c, g, or t
  misc_feature (39)..(42): n is a, c, g, or t
  misc_feature (44)..(44): n is a, c, g, or t
atcacgccactgggcggtgcatccttnncnnnttcggcnnnngngtctcctccctggccctggaggcttgtccagatgcgccgcattcccgctcatcgcacactgccgtttctaacattttccgtggctttctagatgacctgttgttcatgcacttcacttagtgccctcttggacttttgggccgaggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggagccgggtgtgggctgagccctgcctgattgatgctgccaaggaggagtacaacggggtgatagaagaatttttggcaacaggagagaagctttttggaccttatgtttggggaaggtgtggtatcacattgactctagtgtctcctgttaaactgagtcactggcttccattcttcctcttcgtgtggcttttccacctcctgcctcccagagcaaagtttccctgatcccagaagtgaaggagaggaggaagagaggagggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280815 - DNA, 2345 bp, Homo sapiens
gccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280816 - DNA, 1886 bp, Homo sapiens
  misc_feature (27)..(28): n is a, c, g, or t
  misc_feature (30)..(32): n is a, c, g, or t
  misc_feature (39)..(42): n is a, c, g, or t
  misc_feature (44)..(44): n is a, c, g, or t
atcacgccactgggcggtgcatccttnncnnnttcggcnnnngngtctcctccctggccctggaggcttgtccagatgcgccgcattcccgctcatcgcacactgccgtttctaacattttccgtggctttctagatgacctgttgttcatgcacttcacttagtgccctcttggacttttgggccgaggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280817 - DNA, 1968 bp, Homo sapiens
ccaattttccattgaaatatgttgacaaatttccttacacataaatgtctattcatatcagatgatttcaacaatgataaattcttagaaacataatttctgggtctgaactttttttttttttttttttttgagacagagtcccctctctactaaaaatacaaaaattagctgggcgtggtggtgcacacctgtaatcccggctactcaggaggctgatgcagaagaatcgcttgaacccaggaggagacggaggttgcagtgagccaagatcacgccattgcactccagcctgggtgacagagtgaggctttgtctcaaaaataaaataataaaataaatgaaataagataaaataaaaatacagtactttgataaggaaaggtaactgtcagaaaggtgcgattcccccagtcctcacttaggagagagaccaacagcctgagttaaccaagtcctttgtagcccacagcaacagggagctagggactgagtcaggctctctgtaactgtccctatttgccctgggtccccaggagggtaatgttattaagcttcaggtatctgtcgctgttcttcttgaggccacaaggaggcagcacagtgtctctgtcaggaaaatacacttggatgtggtgacagacgttttcccgaggcttacgtttgattctgcaccaggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280818 - DNA, 2325 bp, Homo sapiens
gccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgcagtgtgttccgtgttgcagttctttccagctacg

SEQ ID NO: 280819 - DNA, 1339 bp, Homo sapiens
gcccgtggcctcccagctggttaatgacagagcaggggtaggaacccaggcagcctggtcctagagcctgggtgcttaagtacagtgtggttgtgatcggtaggagaatgtgcacgtgaatagagcatccaccaacttggctctgacaacacagtgctaatttggagcgaaaagcactttcacggtcgaaacggcacagtctctagatgtcgttataactaggaccctgctggagcgaatagttacatgggaaagtaatgttaaatgctggggaaagagtttgggatggagagaggagaaacttgaggtctctgggagttgcttaaaccagttgaccgtaacctggccagagaattctgatagtgtcttctctcctcccaaacaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280820 - DNA, 861 bp, Homo sapiens
tagcaggatccttactccagacagttgaccgtagacgtccccatgttagtatggattgggacgcgtattgagatccatctccatggatctttgtgcgcccaagacagatgcctgaattagagcacttctgatgagaagctcctcattccagctgtgatgcccacatcccttttagcacctagccatggctgctgttagactggcactgggggcagcagggctggacagatccaccaggcaagcttcttaggcatgtgtatgtgtgtttcttgcaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280821 - DNA, 604 bp, Homo sapiens
cagcggaacaagcaatgttgtcaactatgtccagcagatcgtggcacccaagggcagttagaggctcgtgtgcatggcccctgcctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280822 - DNA, 1150 bp, Homo sapiens
gccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttgcgtaacccggcgaaccagcgccaggtgacca

SEQ ID NO: 280823 - DNA, 1128 bp, Homo sapiens
gccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtgtggtatcacattgactctagtgtctcctgttaaactgagtcactggcttccattcttcctcttcgtgtggcttttccacctcctgcctcccagagcaaagtttccctgatcccagaagtgaaggagaggaggaagagaggagggtatgagccaggcttctcactgttgctgaggagagggcctaggagatgaggttctttgtgtgtgtgtgtgtgtgtgtgtgtgtgtgtgtgtgtgtgtgt

SEQ ID NO: 280824 - DNA, 401 bp, Homo sapiens
ggagactaaggttaggtgcacctgcccttgggatgaagaaatgatttcagatctatcaatcaggtcacgtttcagtggtaaattattatatccattcagtggtacttctgaaaaattgcttacttttaaattcttccacctactgaagttgtatgtagccttcctctaaatcccatcagttgagcacagatttagtttcttgaaacctttgtgttctccaagatagactccaggccattatcatcacacacaggtggccggtcatgctcttattcaaactaatcaaaaggaaactctctccaggtaaaatctcctaagctttctctgttgtcaggtcccagatggcttcacagctgtgatgagtgctagcacctgggagaagagaggtccaaataagttct

SEQ ID NO: 280825 - DNA, 2434 bp, Homo sapiens
gccggccggtgagcaacggctctgcggccatggcgagcggcgagcattcccccggcagcggcgcggcccggcggccgctgcactccgcgcaggctgcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280826 - DNA, 3699 bp, Homo sapiens
  misc_feature (964)..(964): n is a, c, g, or t
  misc_feature (979)..(979): n is a, c, g, or t
  misc_feature (1104)..(1104): n is a, c, g, or t
  misc_feature (1579)..(1579): n is a, c, g, or t
  misc_feature (1769)..(1769): n is a, c, g, or t
  misc_feature (1888)..(1888): n is a, c, g, or t
  misc_feature (1910)..(1910): n is a, c, g, or t
aggaaagcattttatctccacagcaatcctatgaggttgatactactatcctcatagaaggggaaactgatgccaggagaggttcaagcgtcttacctgaagtcacaaagcaaactgagtgatgaaggaagacttgaacctagaaaatttcactgcaaagggagtaaaagtccctcgcaatttcgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctcccnttaccctcccgcctnccaccctccctgcaacaacagccctctagcctggggggcttgttagagtagatgtgaaggtttcaggtcgcagcctgtgggactactgctaggtgtgtggggtgtttcgcctgcacccctggttnctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctccccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtcnttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagnaccttgaatccggtgcatgccttggttttggtgctgctgctgcttcccaagatcctcagcagggattaagaaggaacccggtgtgcacagcagatccccgaaattggtgggcttgaccncctggcaaattgctgcgtcttnccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaaaaaaaaaacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280827 - DNA, 3220 bp, Homo sapiens
  misc_feature (3220)..(3220): n is a, c, g, or t
gccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaaaaaaaaaaaaaaaaaaaacaaaaaaaacaaaaaaaaaaaacaaccaaaaacaaatcaacaacacgagggggggcgcgcgccccacaaaaattccccccgcgggggcgccccccctcttcccgcgcccccccccccctttttgtgcgcacagcggggcgcccccccgccgcgccgcgcccttcttcacaccccacggccacccgcgccctctcttaccacccgcgttgctctgggtgtacaacagctgttccctccgtggccctcttccctgccgcgcgcggcccacccctctcttcgcggcgcgcgccgaccatatcatggcggcacccctctcccttccccagcgcctttctcgccccctctcgccgggccaatcccaccctcttccgcggcggtctgctctcagcggtcccccaccgtccgcgctttcttcccctcccccgccccgcaactctctgcgcctccccgcccgctcttctcccgccggaccatctcttccgacgcgccgcgctcccgtcatacactccgccgcccgccgtcggtccggcggggctcctgcgcggcggtgccgtggcggggcggctctggcgggctcggccgcggcgggcctgtcgccgcggcgcgcctcgccgcgcgccgcgcgcgccgcgccgggtcgctgccgctgctcgtcgcgcgcccgtgcgcggcggcgctgccggcgcccgcgctctcccccccccgcgcggcgccgccgccggccgcggggtccggcgcgcgtgccgggcgcgggcgccgccgccggggcgccgctgcgcgctcgcggctcggn

SEQ ID NO: 280828 - DNA, 2103 bp, Homo sapiens
gccggccggtgagcaacggctctgcggccatggcgagcggcgagcattcccccggcagcggcgcggcccggcggccgctgcactccgcgcaggctgtggacgtggcctcggcctccaacttccgggcctttgagctgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280829 - DNA, 2260 bp, Homo sapiens
gccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280830 - DNA, 2406 bp, Homo sapiens
gccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggagccgggtgtgggctgagccctgcctgattgatgctgccaaggaggagtacaacggggtgatagaagaatttttggcaacaggagagaagctttttggaccttatgtttggggaaggtgtggtatcacattgactctagtgtctcctgttaaactgagtcactggcttccattcttcctcttcgtgtggcttttccacctcctgcctcccagagcaaagtttccctgatcccagaagtgaaggagaggaggaagagaggagggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280831 - DNA, 1943 bp, Homo sapiens
ctgtgtggtgatccgatcttgcactccgtcactgtggctgactgcattgtcacattcacttggcggaggccaatttcctacaggtgctttcaggatcaggtcactgcgatggtctctaaacaccattctgctttctctgctctcttgtctttaggagccgggtgtgggctgagccctgcctgattgatgctgccaaggaggagtacaacggggtgatagaagaatttttggcaacaggagagaagctttttggaccttatgtttggggaaggtgtggtatcacattgactctagtgtctcctgttaaactgagtcactggcttccattcttcctcttcgtgtggcttttccacctcctgcctcccagagcaaagtttccctgatcccagaagtgaaggagaggaggaagagaggagggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280832 - DNA, 2432 bp, Homo sapiens
gccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaagaccccaaaaggggaaccgagct

SEQ ID NO: 280833 - DNA, 1359 bp, Homo sapiens
  misc_feature (6)..(8): n is a, c, g, or t
ccgagnnnagcatctacggctaggtacgaggctgggtgttgcagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280834 - DNA, 1291 bp, Homo sapiens
gggaagctgaattctgatctcttccatcgctagtctttgactgtggagctagagaagaacgttacgggtgacaggctacaaaagctcaaatcttgtctgctttctcctctgccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaa

SEQ ID NO: 280835 - DNA, 1593 bp, Homo sapiens
gccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaataccccccggcatgcattccgggggggagggacgagaagagaaaggggagtcacagaggaggctgcagatgagcacgagtttattgactctgcctcgccgtcatggtacgact

SEQ ID NO: 280836 - DNA, 2111 bp, Homo sapiens
gccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcaacacatggacatcactggagaggaaaacccactcaacaagctccgcgtgaagattgaaccaggtccaggaggctcctctgtctgacacccactcccctcaattgagcttggagccccaagttaatgcgaacttcatgttgatcagtgcacgcttagaatactttatttggagggaggggcactccagagctctttgtagccaattctctggcccctgggctgactgaacccaagccattgcagccagataggagttctgtccagtctgtgcggttcgtgatgacttcaccattgctttgcatttgcacaagtccatatcgttttaccaggctctttcgcattccttcatgatcatcagggcagatctgtggattctgtagaataaaagcattagccttattttacagaggatgggactgagtgccagacaagttaagtgtcttgtccaggtcatgtacctaatcagtgcatgactgcaactgagatccgggtcctctctccaaattcagatctttttacttcctaacattttccttcattccatgtgtgactaatctgaaacctttttatgcaattgaagctcatgttccttgatgccgttaagtttgcagatgaatttcttagagacgggtaattagttttagcctggaacagctgtaaaaacaacacattggctgggcatggtggttcacgcctgtaatcccaggtcaaagcgggtggatcatgaggtcaagagttcgagaccagcctagccaatatggagaaccctgtctctactaaaaatacaaaaattagctgggtgtggtgatgcacacctgtaatcccagctactggggaggctgaggcaggagaatcgctcgaccccaggaggcagaggttgcagtgagctgagatcgtgccactgcactccagcctgggtgatagagcaagactccgtctt

SEQ ID NO: 280837 - DNA, 3514 bp, Homo sapiens
ggcgtgcaacggccgttagaggagctgagggagggaaccaccgctcaccgcagacgtagtggctgcagtcagtcttcccgagtgagggatttcgccgcccgctttcaggcccgtttggcttaaataactgtgattgatggccatgcaggagaaatatccaactgaggggatctctcacgtcacttcaccgagttccgatgtgattcagaagggcagttccctggggactgaatggcagaccccagttatctcggagccctttcggagccgcttcagccgctgttcaagtgtagccgacagtggggacacagccattggtacatcatgctcagatattgcggaggatttttgcagctcaagtggcagtcctcctttccagcccatcaaaagccacgtaaccattccaacagcccatgtgatgccttctactttagggacctctcctgccaagccaaattctacacctgttggaccctcttcctctaaactccctttgtcagggttggctgaaagtgtgggaatgacaagaaatggagacctcggtgcaatgaaacattctccaggcctatctagagatctcatgtatttctctggtgctactggagaaaatggaattgagcagtcctggtttccagcagtgggccatgaaagacaagaagaggcgaggaagtttgatattcctagcatggaatctaccctcaatcagtcggcaatgatggagacactttattcagatcctcaccaccgagtccgcttccacaacccaagaaccagcacaagtaaggagttgtacagagtgttgcctgaggccaagaaggcaccgggcagcggggcagtgtttgagcggaatggaccacattctaatagcagtggggtcctccctttgggactccagcctgctcccgggctctccaagcctctgccctctcaggtgtggcagccgagtcctgacacttggcatccccgagagcaatcttgtgaactcagcacttgtcggcagcagctggaattgattcgtttacagatggagcaaatgcagcttcagaatggagccatctgccaccatcctgctgcttttggtccttcactgcccatcttagagccagcacagtggatcagcatcttgaacagtaatgaacaccttctgaaggaaaaagagcttctcattgacaagcagaggaaacacatctctcagctggagcagaaagtgcgagagagcgaactgcaagtccacagtgccctcttgggccgccctgccccctttggtgatgtctgcttgctgaggctacaggaattgcagcgagaaaacactttcttacgtgcacagtttgcacagaagacagaagccttgagcagagaaaagattgaccttgaaaagaaactctctgcttctgaagttgaagtccagctcatcagagagtcgctcaaagtggcgttgcagaagcattctgaggaagtgaagaaacaggaagaaagggtcaaaggtcgtgataaacatatcaataatttgaaaaagaaatgccagaaggaatcagagcagaaccgggagaagcagcagcgtattgagaccttggagcgctacctggctgacctgcccacactggaagaccatcagaagcagagccagcagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagcctagagcaggaagtggctcaagaagaaggaacaagccaggccctgagagaggaggcccagcgaagggattcagccctgcagcagctgcgcacagccgtgaaggagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactcagcacagcacccagagactcagctagatttgcagaagccagatgtgatcaagaggaaactagaagaggttcaacagctgcgtcgtgacattgaggacttaaggaccaccatgtcagacagatatgcccaggacatgggagaaaactgtgtcacacagtgaggaattctgggggattcccccagggaggagctgggctgctgagagcctagtccagcaggtttctgccctgacattctcttgtctgctattcccagagaggtctcagaggggaggggagagcctgcatctgggggccaagggctgattagggaactgtgtcctacccacactggcatgttggattacgtttgtcctgttaattcactctcgacggtgagttactaattaacttttggcaggtacaacagataagtcctcacaaactgttcccagccctaggctgacatgagagacgaacaggctgtccacctttcttctccatccaatgggatggatccatgttcattcccacttcacaccttggtcctgctgattagagagctcatcagaggggcctggaaaggctgagcaagtaccagtgacaatggccatttaagaattctcaggccccatgtgccagccttcttgggaactgagctggctttctgggttttctcatgcctggtcttactgcttcttcctcagggctcttgttctcccagaagcctcagggtaatgtgttggttagcacgtaactactaggattggggccctagggattatagccaggactctaatctgcctaccatgccatttaacaagagatcccactctccagctgccttgtgtccctagggtcctggccatgtgtttagtgtgctaaactttctcctttgttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcaccaccatgctgacgggtatttttcctcataaagtttataaccagttatttatatgaatctttgttatgtccatttgtttgtattgcgtattttgattataaaataaagtatcttaacagac

SEQ ID NO: 280838 - DNA, 1066 bp, Homo sapiens
ccattgttccatctgcgaggagcaccctttctgcagaaagtaaaaattgccttgctgaggaaattaaatatagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagtctcgctcttgtcgcccaggctggagtgcaatggcgcaatctcggctcactgtaacctctgcctcccaggttcaagcaattctcctgcctcagcctcccgagtagctggtattacgggtgcccaccatcacgcccggctaatttttgtattttttgtagagacggggtttcaccacgttggccagactggtctcgaactcctgacctcaggtgatctgcccgcctcggcctcccaaagtgctgggattacaggcgtgagccatcatgcccagcctattacagcatgtaattgggatgtgatgtggtcaggtttgcaactcaggctcaagtgtggaagattggcatcctggagagaagaaaggtccagggggactgttggagaaattctcgtgagaggtgatgagggaacctggcataaggcagcatagcagcgaggagatgtgaggggacagatttaagtgactttaggaggtaacatcaagcggaatcagtgactgacaagatgtaggggttgaagaatagggaagaatcaaatatgactccaggtttctattttgggccagagtgggagtgtctttaactgggttctccaagaaattctgggtaaagcaggttcactcagcgtctctttggactctaaaagttttcacaccaaaacacccgaaatgcactcgttttgagggaataagtg

SEQ ID NO: 280839 - DNA, 3853 bp, Homo sapiens
gcagtcaggtttggggtatgggagagagaacagaatcctgcctcagatgccatactccctgtcctgcatactgagcaagactgtctagttcgcttcattcttcagatagtttggactcgttgctcaccttcctgggggagcttttggaggtcgcagaagattctggtgactcttggaaaggatatttttattagatttgattatagctgagagttgtccagcttccagaagagtaggacctaactcattttccttaaatttttgcagctcaagtggcagtcctcctttccagcccatcaaaagccacgtaaccattccaacagcccatgtgatgccttctactttagggacctctcctgccaagccaaattctacacctgttggaccctcttcctctaaactccctttgtcagggttggctgaaagtgtgggaatgacaagaaatggagacctcggtgcaatgaaacattctccaggcctatctagagatctcatgtatttctctggtgctactggagaaaatggaattgagcagtcctggtttccagcagtgggccatgaaagacaagaagaggcgaggaagtttgatattcctagcatggaatctaccctcaatcagtcggcaatgatggagacactttattcagatcctcaccaccgagtccgcttccacaacccaagaaccagcacaagtaaggagttgtacagagtgttgcctgaggccaagaaggcaccgggcagcggggcagtgtttgagcggaatggaccacattctaatagcagtggggtcctccctttgggactccagcctgctcccgggctctccaagcctctgccctctcaggtgtggcagccgagtcctgacacttggcatccccgagagcaatcttgtgaactcagcacttgtcggcagcagctggaattgattcgtttacagatggagcaaatgcagcttcagaatggagccatctgccaccatcctgctgcttttggtccttcactgcccatcttagagccagcacagtggatcagcatcttgaacagtaatgaacaccttctgaaggaaaaagagcttctcattgacaagcagaggaaacacatctctcagctggagcagaaagtgcgagagagcgaactgcaagtccacagtgccctcttgggccgccctgccccctttggtgatgtctgcttgctgaggctacaggaattgcagcgagaaaacactttcttacgtgcacagtttgcacagaagacagaagccttgagcagagaaaagattgaccttgaaaagaaactctctgcttctgaagttgaagtccagctcatcagagagtcgctcaaagtggcgttgcagaagcattctgaggaagtgaagaaacaggaagaaagggtcaaaggtcgtgataaacatatcaataatttgaaaaagaaatgccagaaggaatcagagcagaaccgggagaagcagcagcgtattgagaccttggagcgctacctggctgacctgcccacactggaagaccatcagaagcagagccagcagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagcctagagcaggaagtggctcaagaagaaggaacaagccaggccctgagagaggaggcccagcgaagggattcagccctgcagcagctgcgcacagccgtgaaggagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactcagcacagcacccagagactcagctagatttgcagaagccagatgtgatcaagaggaaactagaagaggttcaacagctgcgtcgtgacattgaggacttaaggaccaccatgtcagacagatatgcccaggacatgggagaaaactgtgtcacacagtgaggaattctgggggattcccccagggaggagctgggctgctgagagcctagtccagcaggtttctgccctgacattctcttgtctgctattcccagagaggtctcagaggggaggggagagcctgcatctgggggccaagggctgattagggaactgtgtcctacccacactggcatgttggattacgtttgtcctgttaattcactctcgacggtgagttactaattaacttttggcaggtacaacagataagtcctcacaaactgttcccagccctaggctgacatgagagacgaacaggctgtccacctttcttctccatccaatgggatggatccatgttcattcccacttcacaccttggtcctgctgattagagagctcatcagaggggcctggaaaggctgagcaagtaccagtgacaatggccatttaagaattctcaggccccatgtgccagccttcttgggaactgagctggctttctgggttttctcatgcctggtcttactgcttcttcctcagggctcttgttctcccagaagcctcagggtaatgtgttggttagcacgtaactactaggattggggccctagggattatagccaggactctaatctgcctaccatgccatttaacaagagatcccactctccagctgccttgtgtccctagggtcctggccatgtgtttagtgtgctaaactttctcctttgttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcagctttaaagtacagcttttagtgtttcctgggttgtttctctggggctttagtgagggacctttgccctctggtttttcttgcctcctggtttagggagcatctcacacttgttagtatctggttgttgggccagccgtgcctcctctagatctggagccaggccaggcaggggccacgtgtgggccagtcagccactacaagatttttgctaagctttgggctgttggcagcatcttggacctcatgcctgggcctgaatgaggctctttcttaagtgtttttacaagtttgtgttttatttatggagtgacttatcccttccattcagagcagccccacccagccagcccttcagcctctgggctcctgctgcttaaaggcagagccgcctggttggtctccaccctgtgcattgggagcccagccaccatgctgacgggtatttttcctcataaagtttataaccagttatttatatgaatctttgttatgtccatttgtttgtattgcgtattttgattataaaataaagtatcttaacagac

SEQ ID NO: 280840 - DNA, 2383 bp, Homo sapiens
ccattgttccatctgcgaggagcaccctttctgcagaaagtaaaaattgccttgctgaggaaattaaatatagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagcctagagcaggaagtggctcaagaagaaggaacaagccaggccctgagagaggaggcccagcgaagggattcagccctgcagcagctgcgcacagccgtgaaggagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactcagcacagcacccagagactcagctagatttgcagaagccagatgtgatcaagaggaaactagaagaggttcaacagctgcgtcgtgacattgaggacttaaggaccaccatgtcagacagatatgcccaggacatgggagaaaactgtgtcacacagtgaggaattctgggggattcccccagggaggagctgggctgctgagagcctagtccagcaggtttctgccctgacattctcttgtctgctattcccagagaggtctcagaggggaggggagagcctgcatctgggggccaagggctgattagggaactgtgtcctacccacactggcatgttggattacgtttgtcctgttaattcactctcgacggtgagttactaattaacttttggcaggtacaacagataagtcctcacaaactgttcccagccctaggctgacatgagagacgaacaggctgtccacctttcttctccatccaatgggatggatccatgttcattcccacttcacaccttggtcctgctgattagagagctcatcagaggggcctggaaaggctgagcaagtaccagtgacaatggccatttaagaattctcaggccccatgtgccagccttcttgggaactgagctggctttctgggttttctcatgcctggtcttactgcttcttcctcagggctcttgttctcccagaagcctcagggtaatgtgttggttagcacgtaactactaggattggggccctagggattatagccaggactctaatctgcctaccatgccatttaacaagagatcccactctccagctgccttgtgtccctagggtcctggccatgtgtttagtgtgctaaactttctcctttgttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcagctttaaagtacagcttttagtgtttcctgggttgtttctctggggctttagtgagggacctttgccctctggtttttcttgcctcctggtttagggagcatctcacacttgttagtatctggttgttgggccagccgtgcctcctctagatctggagccaggccaggcaggggccacgtgtgggccagtcagccactacaagatttttgctaagctttgggctgttggcagcatcttggacctcatgcctgggcctgaatgaggctctttcttaagtgtttttacaagtttgtgttttatttatggagtgacttatcccttccattcagagcagccccacccagccagcccttcagcctctgggctcctgctgcttaaaggcagagccgcctggttggtctccaccctgtgcattgggagcccagccaccatgctgacgggtatttttcctcataaagtttataaccagttatttatatgaatctttgttatgtccatttgtttgtattgcgtattttgattataaaataaagtatcttaacagac

SEQ ID NO: 280841 - DNA, 2623 bp, Homo sapiens
ggcgtgcaacggccgttagaggagctgagggagggaaccaccgctcaccgcagacgtagtggctgcagtcagtcttcccgagtgagggatttcgccgcccgctttcaggcccgtttggcttaaataactgtgattgatggccatgcaggagaaatatccaactgaggggatctctcacgtcacttcaccgagttccgatgtgattcagaagggcagttccctggggactgaatggcagaccccagttatctcggagccctttcggagccgcttcagccgctgttcaagtgtagccgacagtggggacacagccattggtacatcatgctcagatattgcggaggatttttgcagctcaagtggcagtcctcctttccagcccatcaaaagccacgtaaccattccaacagcccatgtgatgccttctactttagggacctctcctgccaagccaaattctacacctgttggaccctcttcctctaaactccctttgtcagggttggctgaaagtgtgggaatgacaagaaatggagacctcggtgcaatgaaacattctccaggcctatctagagatctcatgtatttctctggtgctactggagaaaatggaattgagcagtcctggtttccagcagtgggccatgaaagacaagaagaggcgaggaagtttgatattcctagcatggaatctaccctcaatcagtcggcaatgatggagacactttattcagatcctcaccaccgagtccgcttccacaacccaagaaccagcacaagtaaggagttgtacagagtgttgcctgaggccaagaaggcaccgggcagcggggcagtgtttgagcggaatggaccacattctaatagcagtggggtcctccctttgggactccagcctgctcccgggctctccaagcctctgccctctcaggtgtggcagccgagtcctgacacttggcatccccgagagcaatcttgtgaactcagcacttgtcggcagcagctggaattgattcgtttacagatggagcaaatgcagcttcagaatggagccatctgccaccatcctgctgcttttggtccttcactgcccatcttagagccagcacagtggatcagcatcttgaacagtaatgaacaccttctgaaggaaaaagagcttctcattgacaagcagaggaaacacatctctcagctggagcagaaagtgcgagagagcgaactgcaagtccacagtgccctcttgggccgccctgccccctttggtgatgtctgcttgctgaggctacaggaattgcagcgagaaaacactttcttacgtgcacagtttgcacagaagacagaagccttgagcagagaaaagattgaccttgaaaagaaactctctgcttctgaagttgaagtccagctcatcagagagtcgctcaaagtggcgttgcagaagcattctgaggaagtgaagaaacaggaagaaagggtcaaaggtcgtgataaacatatcaataatttgaaaaagaaatgccagaaggaatcagagcagaaccgggagaagcagcagcgtattgagaccttggagcgctacctggctgacctgcccacactggaagaccatcagaagcagagccagcagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagtctcgctcttgtcgcccaggctggagtgcaatggcgcaatctcggctcactgtaacctctgcctcccaggttcaagcaattctcctgcctcagcctcccgagtagctggtattacgggtgcccaccatcacgcccggctaatttttgtattttttgtagagacggggtttcaccacgttggccagactggtctcgaactcctgacctcaggtgatctgcccgcctcggcctcccaaagtgctgggattacaggcgtgagccatcatgcccagcctattacagcatgtaattgggatgtgatgtggtcaggtttgcaactcaggctcaagtgtggaagattggcatcctggagagaagaaaggtccagggggactgttggagaaattctcgtgagaggtgatgagggaacctggcataaggcagcatagcagcgaggagatgtgaggggacagatttaagtgactttaggaggtaacatcaagcggaatcagtgactgacaagatgtaggggttgaagaatagggaagaatcaaatatgactccaggtttctattttgggccagagtgggagtgtctttaactgggttctccaagaaattctgggtaaagcaggttcactcagcgtctctttggactctaaaagttttcacaccaaaacacccgaaatgcactcgttttgagggaataagtg

SEQ ID NO: 280842 - DNA, 463 bp, Homo sapiens
agcctagagcaggaagtggctcaagaagaaggaacaagccaggccctgagagaggaggcccagcgaagggattcagccctgcagcagctgcgcacagccgtgaaggaggtgagcaacattagtcagacctcttggttttgcctccacaaacccgatttctttgtttgccctccccatctctaccccaataagagccccagtgtttgaaagggaaaggtccctactgagctctgggggcagaggaaaggtgcattgcatcattctttatattacagaccctaagcctgttttagcatgtccataattattacctaggaaggttttttttttttttttaagacagagtcttgctctgtcgccaggctagagtgcagtggcgcaatctcggctcactgcaacctccgcctcccaggttcaagcgattcccctgcctcagcctcctgtgtagctgggactacaggca

SEQ ID NO: 280843 - DNA, 3940 bp, Homo sapiens
ggcgtgcaacggccgttagaggagctgagggagggaaccaccgctcaccgcagacgtagtggctgcagtcagtcttcccgagtgagggatttcgccgcccgctttcaggcccgtttggcttaaataactgtgattgatggccatgcaggagaaatatccaactgaggggatctctcacgtcacttcaccgagttccgatgtgattcagaagggcagttccctggggactgaatggcagaccccagttatctcggagccctttcggagccgcttcagccgctgttcaagtgtagccgacagtggggacacagccattggtacatcatgctcagatattgcggaggatttttgcagctcaagtggcagtcctcctttccagcccatcaaaagccacgtaaccattccaacagcccatgtgatgccttctactttagggacctctcctgccaagccaaattctacacctgttggaccctcttcctctaaactccctttgtcagggttggctgaaagtgtgggaatgacaagaaatggagacctcggtgcaatgaaacattctccaggcctatctagagatctcatgtatttctctggtgctactggagaaaatggaattgagcagtcctggtttccagcagtgggccatgaaagacaagaagaggcgaggaagtttgatattcctagcatggaatctaccctcaatcagtcggcaatgatggagacactttattcagatcctcaccaccgagtccgcttccacaacccaagaaccagcacaagtaaggagttgtacagagtgttgcctgaggccaagaaggcaccgggcagcggggcagtgtttgagcggaatggaccacattctaatagcagtggggtcctccctttgggactccagcctgctcccgggctctccaagcctctgccctctcaggtgtggcagccgagtcctgacacttggcatccccgagagcaatcttgtgaactcagcacttgtcggcagcagctggaattgattcgtttacagatggagcaaatgcagcttcagaatggagccatctgccaccatcctgctgcttttggtccttcactgcccatcttagagccagcacagtggatcagcatcttgaacagtaatgaacaccttctgaaggaaaaagagcttctcattgacaagcagaggaaacacatctctcagctggagcagaaagtgcgagagagcgaactgcaagtccacagtgccctcttgggccgccctgccccctttggtgatgtctgcttgctgaggctacaggaattgcagcgagaaaacactttcttacgtgcacagtttgcacagaagacagaagccttgagcagagaaaagattgaccttgaaaagaaactctctgcttctgaagttgaagtccagctcatcagagagtcgctcaaagtggcgttgcagaagcattctgaggaagtgaagaaacaggaagaaagggtcaaaggtcgtgataaacatatcaataatttgaaaaagaaatgccagaaggaatcagagcagaaccgggagaagcagcagcgtattgagaccttggagcgctacctggctgacctgcccacactggaagaccatcagaagcagagccagcagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagcctagagcaggaagtggctcaagaagaaggaacaagccaggccctgagagaggaggcccagcgaagggattcagccctgcagcagctgcgcacagccgtgaaggagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactcagcacagcacccagagactcagctagatttgcagaagccagatgtgatcaagaggaaactagaagaggttcaacagctgcgtcgtgacattgaggacttaaggaccaccatgtcagacagatatgcccaggacatgggagaaaactgtgtcacacagtgaggaattctgggggattcccccagggaggagctgggctgctgagagcctagtccagcaggtttctgccctgacattctcttgtctgctattcccagagaggtctcagaggggaggggagagcctgcatctgggggccaagggctgattagggaactgtgtcctacccacactggcatgttggattacgtttgtcctgttaattcactctcgacggtgagttactaattaacttttggcaggtacaacagataagtcctcacaaactgttcccagccctaggctgacatgagagacgaacaggctgtccacctttcttctccatccaatgggatggatccatgttcattcccacttcacaccttggtcctgctgattagagagctcatcagaggggcctggaaaggctgagcaagtaccagtgacaatggccatttaagaattctcaggccccatgtgccagccttcttgggaactgagctggctttctgggttttctcatgcctggtcttactgcttcttcctcagggctcttgttctcccagaagcctcagggtaatgtgttggttagcacgtaactactaggattggggccctagggattatagccaggactctaatctgcctaccatgccatttaacaagagatcccactctccagctgccttgtgtccctagggtcctggccatgtgtttagtgtgctaaactttctcctttgttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcagctttaaagtacagcttttagtgtttcctgggttgtttctctggggctttagtgagggacctttgccctctggtttttcttgcctcctggtttagggagcatctcacacttgttagtatctggttgttgggccagccgtgcctcctctagatctggagccaggccaggcaggggccacgtgtgggccagtcagccactacaagatttttgctaagctttgggctgttggcagcatcttggacctcatgcctgggcctgaatgaggctctttcttaagtgtttttacaagtttgtgttttatttatggagtgacttatcccttccattcagagcagccccacccagccagcccttcagcctctgggctcctgctgcttaaaggcagagccgcctggttggtctccaccctgtgcattgggagcccagccaccatgctgacgggtatttttcctcataaagtttataaccagttatttatatgaatctttgttatgtccatttgtttgtattgcgtattttgattataaaataaagtatcttaacagac

SEQ ID NO: 280844 - DNA, 3847 bp, Homo sapiens
ggcgtgcaacggccgttagaggagctgagggagggaaccaccgctcaccgcagacgtagtggctgcagtcagtcttcccgagtgagggatttcgccgcccgctttcaggcccgtttggcttaaataactgtgattgatggccatgcaggagaaatatccaactgaggggatctctcacgtcacttcaccgagttccgatgtgattcagaagggcagttccctggggactgaatggcagaccccagttatctcggagccctttcggagccgcttcagccgctgttcaagtgtagccgacagtggggacacagccattggtacatcatgctcagatattgcggaggatttttgcagctcaagtggcagtcctcctttccagcccatcaaaagccacgtaaccattccaacagcccatgtgatgccttctactttagggacctctcctgccaagccaaattctacacctgttggaccctcttcctctaaactccctttgtcagggttggctgaaagtgtgggaatgacaagaaatggagacctcggtgcaatgaaacattctccaggcctatctagagatctcatgtatttctctggtgctactggagaaaatggaattgagcagtcctggtttccagcagtgggccatgaaagacaagaagaggcgaggaagtttgatattcctagcatggaatctaccctcaatcagtcggcaatgatggagacactttattcagatcctcaccaccgagtccgcttccacaacccaagaaccagcacaagtaaggagttgtacagagtgttgcctgaggccaagaaggcaccgggcagcggggcagtgtttgagcggaatggaccacattctaatagcagtggggtcctccctttgggactccagcctgctcccgggctctccaagcctctgccctctcaggtgtggcagccgagtcctgacacttggcatccccgagagcaatcttgtgaactcagcacttgtcggcagcagctggaattgattcgtttacagatggagcaaatgcagcttcagaatggagccatctgccaccatcctgctgcttttggtccttcactgcccatcttagagccagcacagtggatcagcatcttgaacagtaatgaacaccttctgaaggaaaaagagcttctcattgacaagcagaggaaacacatctctcagctggagcagaaagtgcgagagagcgaactgcaagtccacagtgccctcttgggccgccctgccccctttggtgatgtctgcttgctgaggctacaggaattgcagcgagaaaacactttcttacgtgcacagtttgcacagaagacagaagccttgagcagagaaaagattgaccttgaaaagaaactctctgcttctgaagttgaagtccagctcatcagagagtcgctcaaagtggcgttgcagaagcattctgaggaagtgaagaaacaggaagaaagggtcaaaggtcgtgataaacatatcaataatttgaaaaagaaatgccagaaggaatcagagcagaaccgggagaagcagcagcgtattgagaccttggagcgctacctggctgacctgcccacactggaagaccatcagaagcagagccagcagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagcctagagcaggaagtggctcaagaagaaggaacaagccaggccctgagagaggaggcccagcgaagggattcagccctgcagcagctgcgcacagccgtgaaggagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactcagcacagcacccagagactcagctagatttgcagaagccagatgtgatcaagaggaaactagaagaggttcaacagctgcgtcgtgacattgaggacttaaggaccaccatgtcagacagatatgcccaggacatgggagaaaactgtgtcacacagtgaggaattctgggggattcccccagggaggagctgggctgctgagagcctagtccagcaggtttctgccctgacattctcttgtctgctattcccagagaggtctcagaggggaggggagagcctgcatctgggggccaagggctgattagggaactgtgtcctacccacactggcatgttggattacgtttgtcctgttaattcactctcgacggtgagttactaattaacttttggcaggtacaacagataagtcctcacaaactgttcccagccctaggctgacatgagagacgaacaggctgtccacctttcttctccatccaatgggatggatccatgttcattcccacttcacaccttggtcctgctgattagagagctcatcagaggggcctggaaaggctgagcaagtaccagtgacaatggccatttaagaattctcaggccccatgtgccagccttcttgggaactgagctggctttctgggttttctcatgcctggtcttactgcttcttcctcagggctcttgttctcccagaagcctcagggtaatgtgttggttagcacgtaactactagggtcctggccatgtgtttagtgtgctaaactttctcctttgttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcagctttaaagtacagcttttagtgtttcctgggttgtttctctggggctttagtgagggacctttgccctctggtttttcttgcctcctggtttagggagcatctcacacttgttagtatctggttgttgggccagccgtgcctcctctagatctggagccaggccaggcaggggccacgtgtgggccagtcagccactacaagatttttgctaagctttgggctgttggcagcatcttggacctcatgcctgggcctgaatgaggctctttcttaagtgtttttacaagtttgtgttttatttatggagtgacttatcccttccattcagagcagccccacccagccagcccttcagcctctgggctcctgctgcttaaaggcagagccgcctggttggtctccaccctgtgcattgggagcccagccaccatgctgacgggtatttttcctcataaagtttataaccagttatttatatgaatctttgttatgtccatttgtttgtattgcgtattttgattataaaataaagtatcttaacagac

SEQ ID NO: 280845 - DNA, 2178 bp, Homo sapiens
ggcgtgcaacggccgttagaggagctgagggagggaaccaccgctcaccgcagacgtagtggctgcagtcagtcttcccgagtgagggatttcgccgcccgctttcaggcccgtttggcttaaataactgtgattgatggccatgcaggagaaatatccaactgaggggatctctcacgtcacttcaccgagttccgatgtgattcagaagggcagttccctggggactgaatggcagaccccagttatctcggagccctttcggagccgcttcagccgctgttcaagtgtagccgacagtggggacacagccattggtacatcatgctcagatattgcggaggatttttgcagctcaagtggcagtcctcctttccagcccatcaaaagccacgtaaccattccaacagcccatgtgatgccttctactttagggacctctcctgccaagccaaattctacacctgttggaccctcttcctctaaactccctttgtcagggttggctgaaagtgtgggaatgacaagaaatggagacctcggtgcaatgaaacattctccaggcctatctagagatctcatgtatttctctggtgctactggagaaaatggaattgagcagtcctggtttccagcagtgggccatgaaagacaagaagaggcgaggaagtttgatattcctagcatggaatctaccctcaatcagtcggcaatgatggagacactttattcagatcctcaccaccgagtccgcttccacaacccaagaaccagcacaagtaaggagttgtacagagtgttgcctgaggccaagaaggcaccgggcagcggggcagtgtttgagcggaatggaccacattctaatagcagtggggtcctccctttgggactccagcctgctcccgggctctccaagcctctgccctctcaggtgtggcagccgagtcctgacacttggcatccccgagagcaatcttgtgaactcagcacttgtcggcagcagctggaattgattcgtttacagatggagcaaatgcagcttcagaatggagccatctgccaccatcctgctgcttttggtccttcactgcccatcttagagccagcacagtggatcagcatcttgaacagtaatgaacaccttctgaaggaaaaagagcttctcattgacaagcagaggaaacacatctctcagctggagcagaaagtgcgagagagcgaactgcaagtccacagtgccctcttgggccgccctgccccctttggtgatgtctgcttgctgaggctacaggaattgcagcgagaaaacactttcttacgtgcacagtttgcacagaagacagaagccttgagcagagaaaagattgaccttgaaaagaaactctctgcttctgaagttgaagtccagctcatcagagagtcgctcaaagtggcgttgcagaagcattctgaggaagtgaagaaacaggaagaaagggtgagctgagtagctgatagccctagttcacaaaggagttggcagtcagctgtctactctaaagcctaagctgtttctggcctggaactaagaggagacaattgggtgagatcctccactggcttctcacacagaatcgtcacagatctcctttttgctagaaatggaactctcctccctccctcatttttgcttcatctccacaaaaccacaacagtcagagaaagttgtatgatccctcactgtcccaggttgtgctgtgcaatgtaccaccagctggtctgggtagaaaaccaacctgagtactcataccaggtggcactgttgcaaaatacacctgtggtatatttgtatcattcagtctggtttctcacccttcctaaaaagtagagaaaaattccatgtgcatcaggcatggtggctcacgcctgtaatcccagcactttgggaggctgaaacgggtggatcacctgaggtccagagttcgagaccagcctggccaacatggtgaaaccccgtctctactaaaggtgcaaaaattggctgggtgtggtggctggcgcctgtagtctcagctacttgggaggctgaagcaggagaatggcttgaacccgggagacagaggttgcagtgaaccaggatcacgccatcatgccattgcactccagcctaggtgatagagcaagactccgtctcaggaa

SEQ ID NO: 280846 - DNA, 506 bp, Homo sapiens
caggattatccagaaaggcagattttggttaattacacagaaccatctttcaagaagtggagatttccaaaaggatcagcactcctaagtaaaggattccccaaatatcggaagcagaagcagatgaatgactggatgatggctcacctgagatgcagaagcaggggcaaatggattggattcagctacttcaagatcctttccttttctaagagctctttagtattatgttgaagactagtaatgaaggtggcacccttgtttctatgcataaggaaactaacaggtaatagagccagactagtagtcaaaagacctaccatcaagctcagtgaccttggacagggtctcactatgctgcacaaggcaatctcaaactctgggctcaagcaatcctccagcctcagccttccaaagtcctgcaattacaggcatgagccagccactacacctgtcctgtacaagctatctgtactttaatgcataaatactgttgcatgtaaatc

SEQ ID NO: 280847 - DNA, 357 bp, Homo sapiens
cctcagcattaggcaaaggagtcctacagcactcttacatgtcattctatttcaacagatgattcaactggtcctgtagatccgatgactgttcaacactaggaattagaatagagacagggtttatctgaaatgagcaataataaagacatctttgtacaactatttacaaattttttttttccattacagacagggtctcactatgctgcacaaggcaatctcaaactctgggctcaagcaatcctccagcctcagccttccaaagtcctgcaattacaggcatgagccagccactacacctgtcctgtacaagctatctgtactttaatgcataaatactgttgcatgtaaatc

SEQ ID NO: 280848 - DNA, 1985 bp, Homo sapiens
agccgccgcctcgccgcttcccctcgtcggagcggccgctcgtccgcccggcttgaggcccgcggggagcgcggcgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtgtactgggagtaagatttgaggttgtaagcaaactaagttagtgtaatttggcttcatatatgtaacgtgaggtattaatgtaattcatatattaaagcaaaaattgttcacagcaagctgacaata

SEQ ID NO: 280849 - DNA, 2805 bp, Homo sapiens
tgaaaagatccttacggcttctgttgtttcatagcttctgcttacagtgttctgggtatccttcagttttgctaccaccctatagcctctcagtgtgcctcacatttagatacctccagagagaatccgattggattcttcagccattatctaatataggggtgcatggcaaccagtgcataaggaaccacttgtggctacttactcagaggagacttcagatctaggagacagtcagagtaccatgtccagaatatataccatgatgaattagcaagatgcagttttcaatacatagatgcaaagtgattatggtatgagaattttttaatctcagattttgtaatttgcttttacaaagcacccatttgacagcaccttgtttaaagaccacaaaaagcatgtccttaaaactatagtcacattcttggtgctcccttcactttgtttggggtattaatactactctgaggctgccatgggaccacctgttccaaaaatattctttgatgtggattgagtagtttttactgtgattattctaccaagataaacatagaatttattgcctttcacagtaataataagaaaacattgttaaagaaggtttcggccaggcacggtggctcacgcctgtaatcccagcactttgggaggccgccgagccaggcagatcacaaggtcaggagtttgagaccagcctgaccaacgtggtgaaatcccatctctactaaaaatacaaaaattagccgggcatggtagcacacacctgtaatcccagctactcaggaggctgaggcaggagaatcacttgaaccggggaggtggaggttgcagtgagctcacatcacgccactgtactccagcctaggtgacagagcgagactctgtctcaaaaaaaaaaaaaaaaaaactttctttggttgactaacaatttttcattgttctaatgggtgtcttcctccttcacaagggaggaagatcctccaaagtatctgtgagtataatcttataactggtgtttttgttaagaaataattaggagtcaccaggcactccattttttaagttcacaaatttcaaactttttttttaaagatttacttcctcattttaatagggacagaaggataaaaagtatatttctgccatcttagggggatggaagttttggtaactctctctcctttgaaggtcctggaatcgtttattataatatataccatttagtatacatgttgggctgtctgaatgagaacatacccatcagtgtgcacatgtgcttacaaacatgttcattcatttagtgaaattaagagtggaagcaggctgttttcagaaaaaatatttgagggctgagttccctctttcattcatcccatgagggtattactagggggtttaatatatttgggttaatgatgagggggaaaaaatagcatccttttggggaaatagaaccagacacaatttaaagtgggacccaaatagaaacataattcttttatgaaacaaatgttttattttctgtttgtcacacggatgccatctaaattttaaaagaaatctaggcttcctcttattctttatgttttttttaaaagcaagaagtcagagactttgtacatcatgattaacttctacatttgtttgagctatgtgtcacaagtaattaagttataaatattctgaagattaattggtgcacactctaagtgctttttaaattttacacagcttacctttctttctgaagaatgtcctcacaaagatagattatatcaatttctccactgatgatgtattccagcaataaacatagtcctagaattgtagaatgtgcactgctgcactctgtcctaacagacagtagacaaggtttataatttttttctatgggacactaaaaataccctaggatttcctttaactttttgcactgacaggtctaaagcaaagccacagaagctgctcttgctcagtaagtattgttaatgctgcagtgcatattaaaatttcagaaaacccaattatgtactatctaggtgtggatagctctcattgttagtatcctaaatcatctaaaggcttgttttctttcttttttttttttttacagacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttattttttt

SEQ ID NO: 280850 - DNA, 3166 bp, Homo sapiens
agccgccgcctcgccgcttcccctcgtcggagcggccgctcgtccgcccggcttgaggcccgcggggagcgcggcgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtgtactgggagtaagatttgaggttgtaagcaaactaagttagtgtaatttggcttcatatatgtaacgtgaggtattaatgtaattcatatattaaagcaaaaattgttcacagcaagctgacaatagaatcaagtgcaggtgagggtttttctttttctttcttttttttttttaaacactctctgggttttagattatttgaaaacactgtaggggatgatggggagatgactacatgatttgcttacacttacatatttaccagcccagtggaccctagattttgtaatttgatattatccatgcattgatttgtatcccattttcttttggttttcttgatgagagctaataaaaacatgagaaaatgtgagcagacctaaaagcctagggccgttaataatgatgatggtgatgatggcagctaagggtatgaaagcaccagtccatttatcattccagggcacagtgaggaggtggctgtttgtatttttggtgtgtttctttcatttagtgaatactgattttctctagtatactcaacatacaatcccaaacatgaaaagttcataaaaagatagtagggatgtcgatctaatacttcttccttaaaaggtcctttttaattttgaatatttgaatgtattttttaattaatgaaatttaattcatcaaaagacctcttcattgctcacactgaaacataaggggaatgtagatggcattttgaattggaatatacaactcacaaattttctttaaaagcgttttatgtgtatatatgaaatgtttcaaatttaataagatttgtctttataagaggccaaaaataattttattaaaaatatacacagaaatacaatagaaatatttccagccaccaataaaacaaatgttcattaaggatagagataaagttactgatccctatttagctgtttaaattcacacaaaaaaatttagtaaaagtaattttcttgaaacagcagcaaataataaactttccttgggaaaacatttttcaaacaacatttaaaaatattctgatgatttgccttttatattgagtttaataatgaagcatattcatcttatttgcaaaagttactcctccagtctgcattcactgttttgaattttttaatatgcacaggccatattctcttttgaatagtttcatttcatgctcactactgttggcactaaattgtaattttttacacttataattattttatatgtcaaacaatattgagatggatgatcaagtttattcacaaatgattttgaatatatttctttaaac

SEQ ID NO: 280851 - DNA, 1447 bp, Homo sapiens
agccgccgcctcgccgcttcccctcgtcggagcggccgctcgtccgcccggcttgaggcccgcggggagcgcggcgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttattttttt

SEQ ID NO: 280852 - DNA, 3113 bp, Homo sapiens
agccgccgcctcgccgcttcccctcgtcggagcggccgctcgtccgcccggcttgaggcccgcggggagcgcggcgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttcactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtgtactgggagtaagatttgaggttgtaagcaaactaagttagtgtaatttggcttcatatatgtaacgtgaggtattaatgtaattcatatattaaagcaaaaattgttcacagcaagctgacaatagaatcaagtgcaggtgagggtttttctttttctttcttttttttttttaaacactctctgggttttagattatttgaaaacactgtaggggatgatggggagatgactacatgatttgcttacacttacatatttaccagcccagtggaccctagattttgtaatttgatattatccatgcattgatttgtatcccattttcttttggttttcttgatgagagctaataaaaacatgagaaaatgtgagcagacctaaaagcctagggccgttaataatgatgatggtgatgatggcagctaagggtatgaaagcaccagtccatttatcattccagggcacagtgaggaggtggctgtttgtatttttggtgtgtttctttcatttagtgaatactgattttctctagtatactcaacatacaatcccaaacatgaaaagttcataaaaagatagtagggatgtcgatctaatacttcttccttaaaaggtcctttttaattttgaatatttgaatgtattttttaattaatgaaatttaattcatcaaaagacctcttcattgctcacactgaaacataaggggaatgtagatggcattttgaattggaatatacaactcacaaattttctttaaaagcgttttatgtgtatatatgaaatgtttcaaatttaataagatttgtctttataagaggccaaaaataattttattaaaaatatacacagaaatacaatagaaatatttccagccaccaataaaacaaatgttcattaaggatagagataaagttactgatccctatttagctgtttaaattcacacaaaaaaatttagtaaaagtaattttcttgaaacagcagcaaataataaactttccttgggaaaacatttttcaaacaacatttaaaaatattctgatgatttgccttttatattgagtttaataatgaagcatattcatcttatttgcaaaagttactcctccagtctgcattcactgttttgaattttttaatatgcacaggccatattctcttttgaatagtttcatttcatgctcactactgttggcactaaattgtaattttttacacttataattattttatatgtcaaacaatattgagatggatgatcaagtttattcacaaatgattttgaatatatttctttaaac

SEQ ID NO: 280853 - DNA, 818 bp, Homo sapiens
agccgccgcctcgccgcttcccctcgtcggagcggccgctcgtccgcccggcttgaggcccgcggggagcgcggcgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcttaatacctaggtgatgagacaatctgtgcaacaaaccaccatggcacctatttacatatgtagcaacctgcacatcctgtacatgtaccccgacttgtataaca

SEQ ID NO: 280854 - DNA, 1832 bp, Homo sapiens
ggcggcggctgaggcaaggggtgggcggggggcgcagcaggcccggcaaatcacggcccggcagcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtg

SEQ ID NO: 280855 - DNA, 1792 bp, Homo sapiens
cacccgcgtatagcttctgccctgggcttggcctgaattgtggcacgagttctttatgcttatggctattacacggggccgcgggccttgtacgcgtacaaggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtg

SEQ ID NO: 280856 - DNA, 1660 bp, Homo sapiens
  misc_feature (25)..(25): n is a, c, g, or t
  misc_feature (28)..(28): n is a, c, g, or t
  misc_feature (35)..(35): n is a, c, g, or t
  misc_feature (37)..(37): n is a, c, g, or t
gttttatgtaacgtgactctcttanttnccaccgntncagattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtg

SEQ ID NO: 280857 - DNA, 1295 bp, Homo sapiens
  misc_feature (44)..(44): n is a, c, g, or t
  misc_feature (49)..(49): n is a, c, g, or t
ataatcttaataattattcttttttattgaataaaatttgtgtngttgncaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtg

SEQ ID NO: 280858 - DNA, 4524 bp, Homo sapiens
tgaaaagatccttacggcttctgttgtttcatagcttctgcttacagtgttctgggtatccttcagttttgctaccaccctatagcctctcagtgtgcctcacatttagatacctccagagagaatccgattggattcttcagccattatctaatataggggtgcatggcaaccagtgcataaggaaccacttgtggctacttactcagaggagacttcagatctaggagacagtcagagtaccatgtccagaatatataccatgatgaattagcaagatgcagttttcaatacatagatgcaaagtgattatggtatgagaattttttaatctcagattttgtaatttgcttttacaaagcacccatttgacagcaccttgtttaaagaccacaaaaagcatgtccttaaaactatagtcacattcttggtgctcccttcactttgtttggggtattaatactactctgaggctgccatgggaccacctgttccaaaaatattctttgatgtggattgagtagtttttactgtgattattctaccaagataaacatagaatttattgcctttcacagtaataataagaaaacattgttaaagaaggtttcggccaggcacggtggctcacgcctgtaatcccagcactttgggaggccgccgagccaggcagatcacaaggtcaggagtttgagaccagcctgaccaacgtggtgaaatcccatctctactaaaaatacaaaaattagccgggcatggtagcacacacctgtaatcccagctactcaggaggctgaggcaggagaatcacttgaaccggggaggtggaggttgcagtgagctcacatcacgccactgtactccagcctaggtgacagagcgagactctgtctcaaaaaaaaaaaaaaaaaaactttctttggttgactaacaatttttcattgttctaatgggtgtcttcctccttcacaagggaggaagatcctccaaagtatctgtgagtataatcttataactggtgtttttgttaagaaataattaggagtcaccaggcactccattttttaagttcacaaatttcaaactttttttttaaagatttacttcctcattttaatagggacagaaggataaaaagtatatttctgccatcttagggggatggaagttttggtaactctctctcctttgaaggtcctggaatcgtttattataatatataccatttagtatacatgttgggctgtctgaatgagaacatacccatcagtgtgcacatgtgcttacaaacatgttcattcatttagtgaaattaagagtggaagcaggctgttttcagaaaaaatatttgagggctgagttccctctttcattcatcccatgagggtattactagggggtttaatatatttgggttaatgatgagggggaaaaaatagcatccttttggggaaatagaaccagacacaatttaaagtgggacccaaatagaaacataattcttttatgaaacaaatgttttattttctgtttgtcacacggatgccatctaaattttaaaagaaatctaggcttcctcttattctttatgttttttttaaaagcaagaagtcagagactttgtacatcatgattaacttctacatttgtttgagctatgtgtcacaagtaattaagttataaatattctgaagattaattggtgcacactctaagtgctttttaaattttacacagcttacctttctttctgaagaatgtcctcacaaagatagattatatcaatttctccactgatgatgtattccagcaataaacatagtcctagaattgtagaatgtgcactgctgcactctgtcctaacagacagtagacaaggtttataatttttttctatgggacactaaaaataccctaggatttcctttaactttttgcactgacaggtctaaagcaaagccacagaagctgctcttgctcagtaagtattgttaatgctgcagtgcatattaaaatttcagaaaacccaattatgtactatctaggtgtggatagctctcattgttagtatcctaaatcatctaaaggcttgttttctttcttttttttttttttacagacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtgtactgggagtaagatttgaggttgtaagcaaactaagttagtgtaatttggcttcatatatgtaacgtgaggtattaatgtaattcatatattaaagcaaaaattgttcacagcaagctgacaatagaatcaagtgcaggtgagggtttttctttttctttcttttttttttttaaacactctctgggttttagattatttgaaaacactgtaggggatgatggggagatgactacatgatttgcttacacttacatatttaccagcccagtggaccctagattttgtaatttgatattatccatgcattgatttgtatcccattttcttttggttttcttgatgagagctaataaaaacatgagaaaatgtgagcagacctaaaagcctagggccgttaataatgatgatggtgatgatggcagctaagggtatgaaagcaccagtccatttatcattccagggcacagtgaggaggtggctgtttgtatttttggtgtgtttctttcatttagtgaatactgattttctctagtatactcaacatacaatcccaaacatgaaaagttcataaaaagatagtagggatgtcgatctaatacttcttccttaaaaggtcctttttaattttgaatatttgaatgtattttttaattaatgaaatttaattcatcaaaagacctcttcattgctcacactgaaacataaggggaatgtagatggcattttgaattggaatatacaactcacaaattttctttaaaagcgttttatgtgtatatatgaaatgtttcaaatttaataagatttgtctttataagaggccaaaaataattttattaaaaatatacacagaaatacaatagaaatatttccagccaccaataaaacaaatgttcattaaggatagagataaagttactgatccctatttagctgtttaaattcacacaaaaaaatttagtaaaagtaattttcttgaaacagcagcaaataataaactttccttgggaaaacatttttcaaacaacatttaaaaatattctgatgatttgccttttatattgagtttaataatgaagcatattcatcttatttgcaaaagttactcctccagtctgcattcactgttttgaattttttaatatgcacaggccatattctcttttgaatagtttcatttcatgctcactactgttggcactaaattgtaattttttacacttataattattttatatgtcaaacaatattgagatggatgatcaagtttattcacaaatgattttgaatatatttctttaaac

SEQ ID NO: 280859 - DNA, 1859 bp, Homo sapiens
agccgccgcctcgccgcttcccctcgtcggagcggccgctcgtccgcccggcttgaggcccgcggggagcgcggcgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtg

SEQ ID NO: 280860 - DNA, 1117 bp, Homo sapiens
cgtacaaggcccgctggcgtgaagccggccccttacattttgcgaagtgcattatatgtccttgtttttctctccctcgtgggggcaacgacccctcccctggcagtaggggtggggtaggtgactctcgctagatccctccaaagcagaccggtggcgatgtcagcggatgtcacgagctcgttagctgcgttcggggaaggttggggcgtcagggagctctcggatcacagcggcccccgccctctcctaggcctggcccggcagagcccccagagtggaccccccagcgactggggtcttctccccactcctccctccttctggtctgatgcggcagtgcgggggccttgtacgcgtacaaggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcggggccttgtacgtacaaggccccgtggggtgttgcagagaagtgaattctcattaggtcccttatgtgtaggtggttgaaaagatgttgatctcggagtcaaatgtgtgatcatgtagaacgcagtggcagtgggatggttatctgtcagcgtaaggtatgggtgcgcagtgtaaggtgaaatatctccatacagaagaggagcggtactg

SEQ ID NO: 280861 - DNA, 2135 bp, Homo sapiens
agccgccgcctcgccgcttcccctcgtcggagcggccgctcgtccgcccggcttgaggcccgcggggagcgcggcgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtgtactgggagtaagatttgaggttgtaagcaaactaagttagtgtaatttggcttcatatatgtaacgtgaggtattaatgtaattcatatattaaagcaaaaattgttcacagcaagctgacaataaaaaaacaacaggcaaaccacaacacaaactctcttttgggcccgcccgggcccttggaaaaagtttttcaacaccccttcggttggggcgccggggccccatagggtacggggaaccttgggccacagcggttccaggaggaacccggg
